United States Patent
Landowski et al.

(10) Patent No.: US 10,435,731 B2
(45) Date of Patent: Oct. 8, 2019

(54) MULTIPLE PROTEASES DEFICIENT FILAMENTOUS FUNGAL CELLS AND METHODS OF USE THEREOF

(71) Applicant: GLYKOS FINLAND OY, Helsinki (FI)

(72) Inventors: Christopher Landowski, Helsinki (FI); Anne Huuskonen, Helsinki (FI); Ann Westerholm-Parvinen, Kirkkonummi (FI); Markku Saloheimo, Helsinki (FI); Anne Kanerva, Helsinki (FI); Jukka Hiltunen, Helsinki (FI)

(73) Assignee: Glykos Finland Oy, Helsinki (FI)

( * ) Notice: Subject to any disclaimer, the term of this patent is extended or adjusted under 35 U.S.C. 154(b) by 638 days.

(21) Appl. No.: 14/903,673

(22) PCT Filed: Jul. 10, 2014

(86) PCT No.: PCT/EP2014/064820
§ 371 (c)(1),
(2) Date: Jan. 8, 2016

(87) PCT Pub. No.: WO2015/004241
PCT Pub. Date: Jan. 15, 2015

(65) Prior Publication Data
US 2016/0237466 A1    Aug. 18, 2016

(30) Foreign Application Priority Data
Jul. 10, 2013 (EP) .................................. 13176001

(51) Int. Cl.
| | | |
|---|---|---|
| *C12N 15/00* | (2006.01) | |
| *C12N 1/14* | (2006.01) | |
| *C12P 21/00* | (2006.01) | |
| *C12P 21/02* | (2006.01) | |
| *C12N 9/14* | (2006.01) | |
| *C12N 9/58* | (2006.01) | |
| *C12N 15/80* | (2006.01) | |
| *C12N 9/10* | (2006.01) | |
| *C12N 9/48* | (2006.01) | |

(52) U.S. Cl.
CPC ............ *C12P 21/00* (2013.01); *C12N 9/1051* (2013.01); *C12N 9/14* (2013.01); *C12N 9/48* (2013.01); *C12N 9/485* (2013.01); *C12N 9/58* (2013.01); *C12N 15/80* (2013.01); *C12P 21/02* (2013.01); *C12Y 204/01258* (2013.01); *C12Y 303/02006* (2013.01); *C12Y 304/00* (2013.01); *C12Y 304/17021* (2013.01); *C12Y 304/21* (2013.01); *C12Y 304/21062* (2013.01); *C12Y 304/21078* (2013.01); *C12Y 304/23* (2013.01); *C12Y 304/23018* (2013.01); *C12Y 304/24* (2013.01)

(58) Field of Classification Search
CPC . C12P 21/005; C07K 16/00; C07K 14/43545; C12N 9/0006
See application file for complete search history.

(56) References Cited

U.S. PATENT DOCUMENTS

| | | | |
|---|---|---|---|
| 4,758,512 A | 7/1988 | Goldberg et al. | |
| 5,674,728 A | 10/1997 | Buxton et al. | |
| 5,693,520 A | 12/1997 | Branner et al. | |
| 5,756,338 A | 5/1998 | Buxton et al. | |
| 5,776,730 A | 7/1998 | Stuart | |
| 5,821,104 A | 10/1998 | Holm et al. | |
| 5,837,847 A | 11/1998 | Royer et al. | |
| 5,840,570 A | 11/1998 | Berka et al. | |
| 5,846,802 A | 12/1998 | Buxton et al. | |
| 5,968,774 A | 10/1999 | Lehmbeck | |
| 5,989,889 A | 11/1999 | Rey et al. | |
| 6,013,452 A | 1/2000 | Christensen et al. | |
| 6,013,489 A | 1/2000 | Musters et al. | |
| 6,025,185 A | 2/2000 | Christensen et al. | |
| 6,291,209 B1 | 9/2001 | Lehmbeck | |
| 6,352,841 B1 | 3/2002 | Lehmbeck | |
| 6,509,171 B1 | 1/2003 | Berka et al. | |
| 6,806,062 B1 | 10/2004 | Hjort et al. | |
| 6,902,922 B2 | 6/2005 | Ness et al. | |
| 7,122,330 B2 | 10/2006 | Emalfarb et al. | |
| 7,163,804 B1 | 1/2007 | Royer et al. | |
| 7,198,938 B2 | 4/2007 | Shuster et al. | |
| 7,303,877 B2 | 12/2007 | Connelly et al. | |
| 7,309,595 B2 | 12/2007 | Dekker et al. | |
| 7,323,327 B2 | 1/2008 | Edens et al. | |
| 7,691,621 B2 | 4/2010 | Wang | |
| 7,771,971 B2 | 8/2010 | Connelly et al. | |
| 7,968,312 B2 | 6/2011 | Sagt et al. | |
| 8,093,016 B2 | 1/2012 | Cervin et al. | |
| 8,288,517 B2 | 10/2012 | Clarkson et al. | |
| 8,329,448 B2 | 12/2012 | Idiris et al. | |
| 8,389,269 B2 | 3/2013 | Sagt et al. | |
| 8,633,010 B2 | 1/2014 | Lehmbeck et al. | |
| 8,741,654 B2 | 6/2014 | Bodie et al. | |
| 8,986,974 B2 | 2/2015 | Maiyuran et al. | |
| 9,102,969 B2 | 8/2015 | Nishiyama et al. | |
| 9,113,649 B2 | 8/2015 | Yu et al. | |
| 9,175,296 B2 | 11/2015 | Punt et al. | |
| 9,255,275 B2 | 2/2016 | Shasky et al. | |
| 9,273,279 B2 | 3/2016 | Wang | |

(Continued)

FOREIGN PATENT DOCUMENTS

| | | |
|---|---|---|
| EP | 0574347 A2 | 12/1993 |
| EP | 1783223 A1 | 5/2007 |

(Continued)

OTHER PUBLICATIONS

Belen Suarez, et al., "Characterization of genesencoding novel peptidases in the biocontrol fungus *Trichoderma harzianum* CECT 2413 using the TrichoEST functional genomics approach", Current Genetics; Eukaryotes with Emphasis on Yeasts, Fungi, Protists, Cell Organelles, Springer, Berlin, DE, vol. 51, No. 5, pp. 331-342 (2007).

(Continued)

*Primary Examiner* — Maryam Monshipouri
(74) *Attorney, Agent, or Firm* — Patrick J. Halloran

(57) ABSTRACT

The present disclosure relates to compositions and methods useful for the production of heterologous proteins in filamentous fungal cells.

9 Claims, 12 Drawing Sheets

Specification includes a Sequence Listing.

(56) References Cited

U.S. PATENT DOCUMENTS

| | | |
|---|---|---|
| 2003/0148464 A1 | 8/2003 | Hjort et al. |
| 2004/0018573 A1 | 1/2004 | Power et al. |
| 2004/0115188 A1 | 6/2004 | Suarez Fernandez et al. |
| 2007/0254336 A1 | 11/2007 | Nikolaev et al. |
| 2008/0108105 A1 | 5/2008 | Van Peij et al. |
| 2008/0248530 A1 | 10/2008 | Hansen et al. |
| 2009/0155239 A1 | 6/2009 | Nakamura |
| 2009/0176219 A1 | 7/2009 | Parenicova et al. |
| 2009/0221030 A1 | 9/2009 | Bao et al. |
| 2009/0253173 A1 | 10/2009 | Wang |
| 2009/0275079 A1 | 11/2009 | Edens et al. |
| 2009/0286280 A1 | 11/2009 | Roubos et al. |
| 2011/0111977 A1 | 5/2011 | Retallack |
| 2011/0165306 A1 | 7/2011 | Dekker et al. |
| 2011/0283422 A1 | 11/2011 | Nelson et al. |
| 2011/0294191 A1 | 12/2011 | Wang |
| 2012/0030839 A1 | 2/2012 | Emalfarb et al. |
| 2012/0149064 A1 | 6/2012 | Wang et al. |
| 2012/0213728 A1 | 8/2012 | Meehl et al. |
| 2012/0231502 A1 | 9/2012 | Hamilton et al. |
| 2012/0232007 A1 | 9/2012 | Bobrowicz et al. |
| 2012/0276075 A1 | 11/2012 | Monod et al. |
| 2012/0328626 A1 | 12/2012 | Sethuraman et al. |
| 2013/0011875 A1 | 1/2013 | Meehl et al. |
| 2014/0212977 A1 | 7/2014 | Yaver et al. |
| 2014/0370546 A1 | 12/2014 | Landowski et al. |
| 2015/0175980 A1 | 6/2015 | Tsang et al. |

FOREIGN PATENT DOCUMENTS

| | | |
|---|---|---|
| EP | 1272669 B1 | 6/2009 |
| EP | 1266011 B1 | 5/2010 |
| WO | 1997/012045 A1 | 4/1997 |
| WO | 1997/046689 A1 | 12/1997 |
| WO | 2000/020596 A1 | 4/2000 |
| WO | 2000/046375 A2 | 8/2000 |
| WO | 2001/079558 A1 | 10/2001 |
| WO | 2004/067709 A2 | 8/2004 |
| WO | 2005/087922 A1 | 9/2005 |
| WO | 2012/048334 A2 | 4/2012 |
| WO | 2014/059541 A1 | 4/2014 |
| WO | 2014/138983 A1 | 9/2014 |
| WO | 2015/025055 A1 | 2/2015 |

OTHER PUBLICATIONS

Druzhinina et al., "Novel traits of Trichoderma predicted through the analysis of its secretome", Fems Microbiology Letters, vol. 337, No. 1, pp. 1-9 (2012).

Frederick et al., "Cloning and characterisation of pepC, a gene encoding a serine protease from Aspergillus niger", Gene. 125, pp. 57-64 (1993).

Janas P, "Production of extracellular enzymes by low-protease mutants of Trichodermareesei",Technologia Alimentaria, vol. 2, No. 2, pp. 103-114 (2003).

Kubicek et al., "Comparative genome sequence analysis underscores mycoparasitism as the ancestral life style of Trichoderma", CGenome Biology? Biomed Central Ltd, London, GB, vol. 12, No. 4, p. R40 (2011).

Mantyla, et al. "Industrial Mutantsand Recombinant Strains of Trichodermareesei", In: Harman G E, KubicekC P (Eds.): "Trichoderma and Gliocladium", Taylor & Francis Ltd, GB, London, vol. 2, pp. 291-309 (1998).

Martinez et al., "Genome sequencing and analysis of the biomass-degrading fungus Trichodermareesei (syn. Hypocreajecorina)", Nature Biotechnology, Nature Publishing Group, New York, NY, US, vol. 26, No. 5, pp. 553-600 (2005).

Martinez, et al. UniProt G0RM29_HYPJQ. "RecName: Full= Leukotriene A(4) hydrolase; Short=LTA-4 hydrolase; EC=3.3.2.6;" (2011).

Marui et al., "Comparison of expression and enzymatic properties of Aspergillus oryzae lysine aminopeptidases ApsA and ApsB", World Journal of Microbiology and Biotechnology, vol. 28, No. 8, pp. 2643-2650 (2012).

Van Den Hombergh et al., "Aspergillus as a host for heterologous protein production: the problem of proteases", Trends in Biotechnology, Elsevier Publications, Cambridge, GB, vol. 15, No. 7, pp. 256-263 (1997).

Ward, P. "Production of recombinant proteins by filamentous fungi", Biotechnology Advances, vol. 30, No. 5, pp. 1119-1139 (2012).

Yoon et al., "Construction of quintuple protease gene disruptant for heterologous protein production in Aspergillus oryzae", Applied Microbiology and Biotechnology, Springer, Berlin, DE, vol. 82, No. 4, pp. 691-701 (2008).

Morya et al., "In Silico Characterization of Alkaline Proteases from Different Species of Aspergillus", Applied Biochemistry and Biotechnology, vol. 166, Issue 1, pp. 243-257 (2012).

Nascimento et al., "Statistical Coupling Analysis of Aspartic Proteinases Based on Crystal Structures of the Trichoderma Reesei Enzyme and its Complex with Pepstatin A", Journal of Molecular Biology, vol. 382, Issue 3, pp. 763-778 (2008).

Nemoto et al., "Isolation of Aspergillus Oryzae Mutants for Heterologous Protein Production from a Double Proteinase Gene Disruptant" Applied Microbiology and Biotechnology, vol. 82, Issue 6, pp. 1105-1114 (2009).

Oda et al., "Nucleotide Sequence of the Gene Encoding the Precursor Protein of Pepstatin Insensitive Acid Protease B, Scytalidopepsin B, from Scytalidium Lignicolum", Bioscience, Biotechnology, and Biochemistry, 62(8), pp. 1637-1639 (1998).

O'Donoghue et al., "Inhibition of a Secreted Glutamic Peptidase Prevents Growth of the Fungus Talaromyces emersonii", Journal of Biological Chemistry, vol. 283. No. 43, pp. 29186-29195 (2008).

Pillai et al., "Crystal Structure of Scytalidoglutamic Peptidase with its First Potent Inhibitor Provides Insights into Substrate Specificity and Catalysis", Journal of Molecular Biology, vol. 365, Issue 2, pp. 343-361 (2007).

Pozo et al., "Functional Analysis of tvsp1, a Serine Protease-Encoding Gene in the Biocontrol Agent Trichoderma Virens", Fungal Genetics and Biology, 41, pp. 336-348 (2004).

Reichard et al., "Molecular Cloning and Sequencing of the Gene Encoding an Extracellular Aspartic Proteinase from Aspergillus Fumigatus", FEMS Microbioly Letters, 130, pp. 69-74 (1995).

Reichard et al., "Molecular Cloning and Targeted Deletion of PEP2 Which Encodes a Novel Aspartic Proteinase from Aspergillus Fumigatus", Int. J. Med. Microbiol., 290, pp. 85-96 (2000).

Reichard et al., "Sedolisins, a New Class of Secreted Proteases from Aspergillus Fumigatus with Endoprotease or Tripeptidyl-Peptidase Activity at acidic pHs", Applied and Environmental Microbiology, vol. 72, No. 3, pp. 1739-1748 (2006).

Roberts et al., "Heterologous Gene Expression in Aspergillus Niger: a Glucoamylase-Porcine Pancreatic Prophospholipase A2 Fusion Protein is Secreted and Processed to Yield Mature Enzyme", Gene., 122, pp. 155-161 (1992).

Sharma et al., "Approaches for Refining Heterologous Protein Production in Filamentous Fungi", World J Microbiol Biotechnol, 25, pp. 2083-2094 (2009).

Sharon et al., "Transcription Factor PrtT Controls Expression of Multiple Secreted Proteases in the Human Pathogenic Mold Aspergillus fumigatus", Infection and Immunity, vol. 77, No. 9, pp. 4051-4060 (2009).

Simkovic et al., "Induction of Secretion of Extracellular Proteases from Trichoderma Viride", Acta Chimica Slovaca, vol. 1, No. 1, pp. 250-264 (2008).

Sims et al., "Glutamic Protease Distribution is Limited to Filamentous Fungi", FEMS Microbiology Letters, 239, pp. 95-101 (2004).

Sriranganadane et al., "Secreted Glutamic Protease Rescues Aspartic Protease Pep Deficiency in Aspergillus Fumigatus During Growth in Acidic Protein Medium", Microbiology, 157, pp. 1541-1550 (2011).

Suárez et al., "Characterization of Genes Encoding Novel Peptidases in the Biocontrol Fungus Trichoderma harzianum CECT 2413 Using the TrichoEST Functional Genomics Approach", Curr Genet, 51, pp. 331-342 (2007).

(56) References Cited

OTHER PUBLICATIONS

Uusitalo et al., Enzyme Production by Recombinant Trichoderma Reesei Strains. Journal of Biotechnology, 17, pp. 35-50 (1991).
Van Den Hombergh et al., "New Protease Mutants in Aspergillus Niger Result in Strongly Reduced in Vitro Degradation of Target Proteins; Genetical and Biochemical Characterization of Seven Complementation Groups", Curr Genet, 28, pp. 299-308 (1995).
Van Den Hombergh et al., "Improve the Efficiency of Protein Expression in Fungi", Chemtech 26, pp. 30-37 (1996).
Van Den Hombergh et al. Production of the homologous pectin lyase B protein in six genetically defined protease-deficient Aspergillus niger mutant strains. Curr Genet. 32:73 (1997).
Van Den Hombergh, et al. Disruption of three acid proteases in Aspergillus niger. Eur. J. Biochem. 247: 605-613 (1997).
Van Kuyk et al., "Analysis of Two Aspergillus Nidulans Genes Encoding Extracellular Proteases", Fungal Genetics and Biology, vol. 29, pp. 201-210 (2000).
Vázquez-Laslop et al., "Characterization of a Vacuolar Protease in Neurospora Crassa and the Use of Gene Riping to Generate Protease-Deficient Strains", The Journal of Biological Chemistry, vol. 271, No. 36, pp. 21944-21949 (1996).
Vinterová et al., "Evidence for the Presence of Proteolytically Active Secreted Aspartic Proteinase of Candida Parapsilosis in the Cell Wall", Protein Science, vol. 20, pp. 2004-2012 (2011).
Wang et al., "Bioprocessing Strategies to Improve Heterologous Protein Production in Filamentous Fungal Fermentations", Biotechnology Advances, vol. 23, pp. 115-129 (2005).
Wang et al., "Isolation of Four Pepsin-Like Protease Genes from Aspergillus Niger and Analysis of the Effect of Disruptions on Heterologous Laccase Expression", Fungal Genetics and Biology, vol. 45, pp. 17-27 (2008).
Xu et al., "Increased Heterologous Protein Production in Aspergillus Niger Fermentation through Extracellular Proteases Inhibition by Pelleted Growth", Biotechnol Prog., vol. 16, No. 2, pp. 222-227 (2000).
Yan et al., "Cloning and Heterologous Expression of SS10, A Subtilisin-Like Protease Displaying Antifungal Activity from Trichoderma Harzianum", FEMS Microbiology Letters, vol. 290, pp. 54-61 (2009).
Yoon, et al. Construction of quintuple protease gene disruptant for heterologous protein production in aspergillus oryzae. Appl. Microbiol. Biotechnol. 82: 691-701 (2009).
Yoon, et al. Disruption of ten protease genes in the filamentous fungus *Aspergillus oryzae* highly improves production of heterologous proteins. Appl. Microbiol. Biotechnol. 89: 747-759 (2010).
Zhu et al., "Improved Heterologous Protein Production by a Tripeptidyl Peptidase Gene (Aosedd) Disruptant of the Filamentous Fungus *Aspergillus oryzae*", The Journal of General and Applied Microbiology, vol. 58, pp. 199-209 (2012).
Zhu et al., "Further Enhanced Production of Heterologous Proteins by Double-Gene Disruption (ΔAosedD ΔAovps10) in a Hyper-Producing Mutant of Aspergillus Oryzae", Applied Microbiology and Biotechnology, vol. 97, pp. 6347-6357 (2013).
Adav et al., "Proteomic Analysis of pH and Strains Dependent Protein Secretion of Trichoderma Reesei", J Proteome Res., (10)10, pp. 4579-4596 (2011).
Ahamed, et al. Chymostatin can combine with pepstatin to eliminate extracellular protease activity in cultures of Aspergillus niger NRRL-3. J. Ind. Microbiol. Biotechnol. 34: 165-169 (2007).
Archer et al., "Proteolytic Degradation of Heterologous Proteins Expressed in Aspergillus Niger", Biotechnology Letters, vol. 14, Issue 5, pp. 357-362 (1992).
Baldwin, et al. Develop Systems for Manufacturing 100,000,000 Doses of an Emergency Pharmaceutical (e.g. Vaccine or Monoclonal Antibody) Within 2 Months of Product Identification, Genencor International (Jun. 6, 2009).
Behnsen et al., "Secreted Aspergillus Fumigatus Protease Alp1 Degrades Human Complement Proteins C3, C4, and C5", Infect Immun., 78(8), pp. 3585-3594 (2010).

Berka et al., "Molecular Cloning and Deletion of the Gene Encoding Aspergillopepsin a from Aspergillus Awamori", Gene., 86(2), pp. 153-162 (1990).
Broekhuijsen et al., "Secretion of Heterologous Proteins by Aspergillus Niger: Production of Active Human Interleukin-6 in a Protease-Deficient Mutant by KEX2-like Processing of a Glucoamylase-hIL6 Fusion Protein", Journal of Biotechnology, 31(2), pp. 135-145 (1993).
Dal Degan et al., "Purification and Characterization of two Serine Carboxypeptidases from Aspergillus Niger and their use in C-terminal Sequencing of Proteins and Peptide Synthesis", Applied and Environment Microbiology, 58(7), pp. 2144-2152 (1992).
Delgado-Jarana et al., "Overproduction of Beta-1,6-glucanase in Trichoderma Harzianum is Controlled by Extracellular Acidic Proteases and pH", Biochimca et Biophysica Acta, 1481(2), pp. 289-296 (2000).
Delgado-Jarana et al., "Aspartyl Protease from Trichoderma Harzianum CECT 2413: Cloning and Characterization" Microbiology, 148(Pt 5), pp. 1305-1315 (2002).
Diener et al., "Characterization of the Protein Processing and Secretion Pathways in a Comprehensive Set of Expressed Sequence Tags from Trichoderma reesei", FEMS Microbiology Letters, 230(2), pp. 275-282 (2004).
Dienes et al., "Identification of a trypsin-like Serine Protease from Trichoderma reesei QM9414", Enzyme and Microbial Technology, vol. 40, Issue 5, pp. 1087-1094 (2007).
Durand-Poussereau et al., "Characterization of a Protease Deficient Strain of Penicillium Roqueforti Generated by Heterologous Plasmid Integration: Potential use for Protein Production", Journal of Biotechnology, 51(1), pp. 97-105 (2006).
Edens et al.,"Extracellular Prolyl Endoprotease from Aspergillus Niger and its use in the Debittering of Protein Hydrolysates", Journal of Agricultural and Food Chemistry, 53(20), pp. 7950-7957 (2005).
Eneyskaya et al., "Acid protease from Trichoderma reesei: Limited Proteolysis of Fungal Carbohydrases", Applied Microbiology and Biotechnology, vol. 52, Issue 52, pp. 226-231 (1999).
Foreman et al., "Transcriptional Regulation of Biomass-degrading Enzymes in the Filamentous Fungus *Trichoderma reesei*", Journal of Biological Chemistry, vol. 278, No. 34, pp. 31988-31997 (2003).
Frenken et al., "Recent Advances in the Large-scale Production of Antibody Fragments using Lower Eukaryotic Microorganisms", Research in Immunology, vol. 149, Issue 6, pp. 589-599 (1998).
Fujinaga et al., "The Molecular Structure and Catalytic Mechanism of a Novel Carboxyl Peptidase from Scytalidium Lignicolum", Proc Natl Acad Sci U S A, vol. 101, No. 10, pp. 3364-3369 (2004).
Gagnon-Arsenault et al., "Fungal Yapsins and Cell Wall: a Unique Family of Aspartic Peptidases for a Distinctive Cellular Function", FEMS Yeast Research, 6(7), pp. 966-978 (2006).
Gouka et al., "Efficient Production of Secreted Proteins by Aspergillus: Progress, Limitations and Prospects", Applied Microbiology and Biotechnology, vol. 47, Issue 1, pp. 1-11 (1997).
Haab et al., "Formation of the Extracellular Proteases from Trichoderma reesei QM 9414 Involved in Cellulase Degradation", Journal of Biotechnology, vol. 16, Issue 3-4, pp. 187-198 (1990).
Hagspiel et al., "Protease Activity and Proteolytic Modification of cellulases from a Trichoderma reesei QM 9414 selectant", Applied Microbiology and Biotechnology, vol. 32, Issue 1, pp. 61-67 (1999).
Hintz et al., Improved gene expression in Aspergillus nidulans. Can. Jo. Bot. 73 (Supp. 1): S876-S884 (1995).
Huang et al., "Identification of a Glutamic Acid and an Aspartic Acid Residue Essential for Catalytic Activity of Aspergillopepsin II, a non-pepsin type Acid Proteinase", The Journal of Biological Chemistry, vol. 275, No. 34, pp. 26607-26614 (2000).
Idiris, et al. Enhanced protein secretion from multiprotease-deficient fission yeast by modification of its vacuolar protein sorting pathway. Appl. Microbiol. Biotechnol. 85: 667-677 (2010).
Inoue et al., "The Gene and Deduced Protein Sequences of the Zymogen of Aspergillus Niger acid Proteinase A", The Journal of Biological Chemistry, vol. 266, No. 29, pp. 19484-19489 (1991).
Jarai et al., "Cloning and Characterization of the pepE Gene of Aspergillus Niger Encoding a new Aspartic Protease and Regulation of pepE and pepC", Gene., 145(2), pp. 171-178 (1994).

(56) References Cited

OTHER PUBLICATIONS

Jin et al., "Double Disruption of the Proteinase Genes, tppA and pepE, Increases the Production Level of Human Lysozyme by Aspergillus Oryzae", Applied Microbiology and Biotechnology, vol. 76, Issue 5, pp. 1059-1068 (2007).

Kakimori et al., "Nucleotide Sequence of the Gene Encoding Pepstatin-insensitive Acid Protease B, Scytalidopepsin B, of Scytalidium Lignicolum", Bioscience Biotechnology and Biochemistry, 60(7), pp. 1210-1211 (1996).

Kataoka et al., "Catalytic residues and substrate specificity of scytalidoglutamic peptidase, the first member of the eqolisin in family (G1) of peptidases", FEBS Letters, 579(14), pp. 2991-2994 (2005).

Kimura et al., "Monitoring Global Gene Expression of Proteases and Improvement of Human Lysozyme Production in the nptB gene disruptant of Aspergillus oryzae" Bioscience, Biotechnology, and Biochemistry, vol. 72, Issue 2, pp. 499-505 (2008).

Kruszewska, "Heterologous expression of genes in filamentous fungi", Acta Biochimica Polonica, vol. 46, No. 1, 181-195 (1999).

Krysan, et al. Yapsins are a family of aspartyl proteases required for cell wall integrity in *Saccharomyces cerevisiae*. Eukaryotic Cell. 4(8): 1364-1374 (2005).

Kuroda, et al. Antibody expression in protease-deficient strains of the methlotrophic yeast ogataea minuta. FEMS Yeast Res. 7: 1307-1316 (2007).

Liu et al., "A new Serine Protease Gene from Trichoderma Harzianum is Expressed in *Saccharomyces cerevisiae*", Prikl Biokhim Mikrobiol., 45(1), pp. 28-32 (2009).

Lu et al., "Molecular Cloning of a cDNA for Proctase B from *Aspergillus niger* Var. Macrosporus and Sequence Comparison with Other Aspergillopepsins I", Bioscience, Biotechnology, and Biochemistry, 59(5), pp. 954-955 (1995).

Lubertozzi et al., "Developing Aspergillus as a Host for Heterologous Expression", Biotechnology Advances, 27(1), pp. 53-75 (2009).

Maita et al., "Complete Amino Acid Sequence of Scytalidium Lignicolum Acid Protease B", Journal of Biochemistry, 95(2), pp. 465-475 (1984).

Margolles-Clark et al., "Improved Production of Trichoderma Harzianum Endochitinase by Expression in Trichoderma Reesei", Applied and Environmental Microbiology, vol. 2, No. 6, pp. 2145-2151 (1996).

Martinez, et al. Uniprot GORG34, XP002712642 (Oct. 19, 2011).
Martinez, et al. Uniprot GORIW3, XP002712643 (Oct. 19, 2011).
Martinez, et al. Uniprot GORHO5, XP002712644 (Oct. 19, 2011).
Martinez, et al. Uniprot GORSP8, XP002712645 (Oct. 19, 2011).
Martinez, et al. Uniprot GORVKO, XP002712646 (Oct. 19, 2011).
Martinez, et al. Uniprot GOR8TO, XP002712646 (Oct. 19, 2011).

Maruyama et al., "Multiple Gene Disruptions by Marker Recycling with Highly Efficient Gene-Targeting Background (DeltaligD) in Aspergillus Oryzae", Biotechnol Letters, vol. 30, Issue 10, pp. 1811-1817 (2008).

Mattern et al., "Isolation and Characterization of Mutants of Aspergillus Niger Deficient in Extracellular Proteases", Molecular and General Genetics MGG, vol. 234, Issue 2, pp. 332-336 (1992).

Moralejo et al., "Thaumatin Production in Aspergillus Awamori by Use of Expression Cassettes with Strong Fungal Promoters and High Gene Dosage", Applied and Environmental Microbiology, vol. 65 No. 3, pp. 1168-1174 (1999).

Moralejo et al., "Overexpression and Lack of Degradation of Thaumatin in an Aspergillopepsin A-Defective Mutant of Aspergillus Awamori Containing an Insertion in the pepA gene", Applied Microbiology and Biotechnology, vol. 54, Issue 6, pp. 772-777 (2000).

Moralejo et al., "Silencing of the Aspergillopepsin B (pepB) Gene of Aspergillus Awamori by Antisense RNA Expression or Protease Removal by Gene Disruption Results in a Large Increase in Thaumatin Production", Applied and Environmental Microbiology, vol. 68, No. 7, pp. 3550-3559 (2002).

MULTIPLE PROTEASES DEFICIENT FILAMENTOUS FUNGAL CELLS AND METHODS OF USE THEREOF

This application was filed under 35 U.S.C. § 371 and claims priority to International Application No. PCT/EP2014/064820 filed Jul. 10, 2014, and claims priority to EP 13176001.9 filed Jul. 10, 2013, which are hereby incorporated by reference into this disclosure in their entirety.

FIELD OF THE INVENTION

The present disclosure relates to compositions and methods useful for the production of heterologous proteins in filamentous fungal cells.

BACKGROUND

Posttranslational modification of eukaryotic proteins, particularly therapeutic proteins such as immunoglobulins, is often necessary for proper protein folding and function. Because standard prokaryotic expression systems lack the proper machinery necessary for such modifications, alternative expression systems have to be used in production of these therapeutic proteins. Even where eukaryotic proteins do not have posttranslational modifications, prokaryotic expression systems often lack necessary chaperone proteins required for proper folding. Yeast and fungi are attractive options for expressing proteins as they can be easily grown at a large scale in simple media, which allows low production costs, and yeast and fungi have posttranslational machinery and chaperones that perform similar functions as found in mammalian cells. Moreover, tools are available to manipulate the relatively simple genetic makeup of yeast and fungal cells as well as more complex eukaryotic cells such as mammalian or insect cells (De Pourcq et al., Appl Microbiol Biotechnol, 87(5):1617-31). Despite these advantages, many therapeutic proteins are still being produced in mammalian cells, which produce therapeutic proteins with posttranslational modifications most resembling the native human proteins, whereas the posttranslational modifications naturally produced by yeast and fungi often differ from that found in mammalian cells.

To address this deficiency, new strains of yeast and fungi are being developed that produce posttranslational modifications that more closely resemble those found in native human proteins. Thus, there has been renewed interest in using yeast and fungal cells to express more complex proteins. However, due to the industry's focus on mammalian cell culture technology for such a long time, the fungal cell expression systems such as *Trichoderma* are not as well established as mammalian cell culture and therefore suffer from drawbacks when expressing mammalian proteins.

Thus, a need remains in the art for improved filamentous fungal cells, such as *Trichoderma* fungus cells, that can stably produce heterologous proteins, such as immunoglobulins, preferably at high levels of expression.

SUMMARY

Described herein are compositions including filamentous fungal cells, such as *Trichoderma* fungal cells having reduced or no detectable activity of at least three proteases, and having a recombinant polynucleotide encoding a heterologous polypeptide that is produced at increased levels. Further described herein are methods of improving heterologous polypeptide stability and methods of making heterologous polypeptides in which the proteases do have the reduced activity. Further described herein are compositions including filamentous fungal cells, such as *Trichoderma* fungal cells, having reduced or no detectable activity in one or more of the following proteases: pep9, amp1, amp2, and sep1.

Thus one aspect includes filamentous fungal cells comprising at least one endogenous protease having reduced or no protease activity, and a recombinant polynucleotide encoding heterologous polypeptide, wherein the cell has reduced or no protease activity in one or more of the following proteases: pep9, amp1, amp2, and sep2. In one specific embodiment, the production level of the polypeptide is at least two-fold higher than the production level of the same polypeptide as produced in a corresponding filamentous fungal cell in which the proteases do not have the reduced activity.

In another aspect, that may be combined with the precedent embodiment, it includes filamentous fungal cells having reduced or no detectable activity of at least three proteases, where the cell further contains a recombinant polynucleotide encoding a heterologous polypeptide produced at a level of at least 2-fold higher than the production level of the polypeptide in a corresponding parental filamentous fungal cell in which the proteases do not have the reduced activity. In certain embodiments, when the cell is an *Aspergillus* cell, the total protease activity is reduced to 50% or less of the total protease activity of the corresponding parental *Aspergillus* cell in which the protease do not have reduced activity.

In one embodiment that may be combined with the preceding embodiments, the total protease activity of the filamentous fungal cell is reduced to 49% or less, 40% or less, 31% or less, 6% or less, of the total protease activity of the corresponding parental filamentous fungal cell in which the proteases do not have the reduced activity.

In certain embodiments, the expression level of at least three proteases is reduced or eliminated. In certain embodiments, genes encoding the three proteases each comprise a mutation that reduces or eliminates the corresponding protease activity. In certain embodiments that may be combined with the preceding embodiments, the three protease encoding genes are pep1, tsp1, and slp1. In other embodiments, the three protease encoding genes are gap1, slp1, and pep1.

In certain embodiments, the fungal cells have reduced or no detectable activity of four endogenous proteases; genes encoding the four proteases each comprise a mutation that reduces or eliminates the corresponding protease activity. In certain embodiments that may be combined with the preceding embodiments, the four protease encoding genes are pep1, tsp1, slp1, and gap1.

In certain embodiments that may be combined with the preceding embodiments, the three or four protease encoding genes are selected from pep1, pep2, pep3, pep4, pep5, pep8, pep11, pep12, tsp1, slp1, slp2, slp3, slp7, gap1, and gap2. In certain embodiments that may be combined with the preceding embodiments, the three or four protease encoding genes are selected from pep1, pep3, pep4, tsp1, slp1, slp2, gap1, and gap2. In certain embodiments, the three or four protease encoding genes are selected from pep1, pep2, pep3, pep4, pep5, gap1, gap2, slp1, slp2, and tsp1.

In other embodiments, the fungal cells have reduced or no detectable activity of five endogenous proteases; genes encoding the five proteases each comprise a mutation that reduces or eliminates the corresponding protease activity. In certain embodiments that may be combined with the preceding embodiments, the five protease encoding genes are pep1, tsp1, slp1, gap1, and pep4. In other embodiments, the five protease encoding genes are pep1, tsp1, slp1, gap1, and gap2.

In certain embodiments, the fungal cells have reduced or no detectable activity of six endogenous proteases; genes encoding the six proteases each comprise a mutation that reduces or eliminates the corresponding protease activity. In certain embodiments, the cell has six protease encoding genes, each of which comprise a mutation that reduces or eliminates the corresponding protease activity, and the six protease encoding genes are pep1, tsp1, slp1, gap1, gap2, and pep4.

In certain embodiments that may be combined with the preceding embodiments, the fungal cells have three to six proteases having reduced or no detectable activity in each of the three to six proteases selected from pep1, pep2, pep3, pep4, pep5, tsp1, slp1, slp2, slp3, gap1, and gap2.

In certain embodiments that may be combined with the preceding embodiments, the cell has seven protease encoding genes, each of which comprise a mutation that reduces or eliminates the corresponding protease activity, and the seven protease encoding genes are pep1, tsp1, slp1, gap1, gap2, pep4, and pep3.

In certain embodiments that may be combined with the preceding embodiments, the cell has eight protease encoding genes, each of which comprise a mutation that reduces or eliminates the corresponding protease activity, and the eight protease encoding genes are pep1, tsp1, slp1, gap1, gap2, pep4, pep3, and pep5.

In certain embodiments that may be combined with the preceding embodiments, the fungal cell has an additional protease having reduced activity, the gene encoding the additional protease comprises a mutation that reduces or eliminates the corresponding protease activity, and the additional protease is selected from pep7, pep8, pep11, pep12, tpp1, gap2, slp3, slp5, slp6, slp7, and slp8.

In certain embodiments that may be combined with the preceding embodiments, the cell has eight protease encoding genes, each of which comprise a mutation that reduces or eliminates the corresponding protease activity, and the eight protease encoding genes are either
a) pep1, slp1, gap1, gap2, pep4, pep3, pep5, amp1,
b) pep1, slp1, gap1, gap2, pep4, pep3, pep5, amp2,
c) pep1, slp1, gap1, gap2, pep4, pep3, pep5, sep1,
d) pep1, slp1, gap1, gap2, pep4, pep3, pep5, pep9, or
e) pep1, slp1, gap1, gap2, pep4, pep3, pep5, pep2.

Optionally, in one specific embodiment of the preceding embodiment, the cell further comprises a mutation that reduces or eliminates the protease activity of tsp1.

In certain embodiments that may be combined with the preceding embodiments, the cell has nine protease encoding genes, each of which comprise a mutation that reduces or eliminates the corresponding protease activity, and the nine protease encoding genes are pep1, slp1, gap1, gap2, pep4, pep3, pep5, pep2 and sep1. Optionally, in one specific embodiment of such embodiment, the cell further comprises a mutation that reduces or eliminates the protease activity of tsp1.

In certain embodiments that may be combined with the preceding embodiments, the cell has ten protease encoding genes, each of which comprise a mutation that reduces or eliminates the corresponding protease activity, and the ten protease encoding genes are pep1, slp1, gap1, gap2, pep4, pep3, pep5, pep2, sep1 and slp8. Optionally, in one specific embodiment of such embodiment, the cell further comprises a mutation that reduces or eliminates the protease activity of tsp1.

In certain embodiments that may be combined with the preceding embodiments, the cell has eleven protease encoding genes, each of which comprise a mutation that reduces or eliminates the corresponding protease activity, and the eleven protease encoding genes are pep1, slp1, gap1, gap2, pep4, pep3, pep5, pep2, sep1, slp8 and amp2. Optionally, in one specific embodiment of such embodiment, the cell further comprises a mutation that reduces or eliminates the protease activity of tsp1.

In certain embodiments that may be combined with the preceding embodiments, the cell has twelve protease encoding genes, each of which comprise a mutation that reduces or eliminates the corresponding protease activity, and the twelve protease encoding genes are pep1, slp1, gap1, gap2, pep4, pep3, pep5, pep2, sep1, slp8, amp2 and slp7.

In certain embodiments that may be combined with the preceding embodiments, the cell has reduced or no protease activity in at least thirteen proteases, each of the genes encoding the thirteen proteases comprises a mutation that reduces or eliminates the corresponding protease activity, and the thirteen proteases are either
  pep1, tsp1, slp1, gap1, gap2, pep4, pep3, pep5, pep2, sep1, slp8, amp2, pep9;
  pep1, tsp1, slp1, gap1, gap2, pep4, pep3, pep5, pep2, sep1, slp8, amp2, slp7;
  pep1, tsp1, slp1, gap1, gap2, pep4, pep3, pep5, pep2, sep1, slp8, amp2, slp3.

In certain embodiments that may be combined with the preceding embodiments, the cell has reduced or no protease activity in at least fourteen proteases, each of the genes encoding the fourteen proteases comprises a mutation that reduces or eliminates the corresponding protease activity, and the fourteen proteases are pep1 tsp1 slp1 gap1 gap2 pep4 pep3 pep5 pep2 sep1 slp8 amp2 pep9 slp2;

In certain embodiments that may be combined with the preceding embodiments, the cell has reduced or no protease activity in at least fifteen proteases, each of the genes encoding the fifteen proteases comprises a mutation that reduces or eliminates the corresponding protease activity, and the fifteen proteases are either
  pep1 tsp1 slp1 gap1 gap2 pep4 pep3 pep5 pep2 sep1 slp8 amp2 pep9 slp2 mp1; or,
  pep1 tsp1 slp1 gap1 gap2 pep4 pep3 pep5 pep2 sep1 slp8 amp2 pep9 slp2 mp5.

In certain embodiments that may be combined with the precedent embodiments, the cell has reduced or no protease activity in at least sixteen, at least seventeen, at least eighteen, at least nineteen, or at least twenty or more proteases, and said cell comprises at least one mutation that reduces or eliminates the corresponding protease activity, selected from the group consisting of
  an aspartic protease pep6, pep10, pep13, pep14, or pep16;
  slp like protease slp57433, slp35726, slp60791, or slp109276;
  gap like protease gap3 or gap4;
  sedolisin like protease sed2, sed3, or sed5;
  Group A protease selected from the group of protease65735, protease77577, protease81087, protease56920, protease122083, protease79485, protease120998, or protease61127;
  Group B protease selected from the group of protease21659, protease58387, protease75159, protease56853, or protease64193;
  Group C protease selected from the group of protease82452, protease80762, protease21668, protease81115, protease82141, protease23475;

Group D protease selected from the group of protease121890, protease22718, protease47127, protease61912, protease80843, protease66608, protease72612, protease40199; or Group E protease selected from the group of protease22210, protease111694, protease82577.

In certain embodiments that may be combined with the preceding embodiments, the heterologous polypeptide is a mammalian polypeptide. In certain embodiments, the mammalian polypeptide is glycosylated.

In certain embodiments, the mammalian polypeptide is selected from an immunoglobulin, an antibody and their antigen-binding fragments, a growth factor, an interferon, a cytokine, and an interleukin. In certain embodiments, the mammalian polypeptide is an immunoglobulin or an antibody, or their Fc fragment. In certain embodiments, the mammalian polypeptide is selected from insulin-like growth factor 1 (IGF1), human growth hormone (hGH), and interferon alpha 2b (IFNα2b).

In certain embodiments that may be combined with the preceding embodiments, the heterologous polypeptide is a non-mammalian polypeptide. In certain embodiments, the non-mammalian polypeptide is an aminopeptidase, amylase, carbohydrase, carboxypeptidase, catalase, cellulase, chitinase, cutinase, deoxyribonuclease, esterase, alpha-galactosidase, beta-galactosidase, glucoamylase, alpha-glucosidase, beta-glucosidase, invertase, laccase, lipase, mutanase, oxidase, pectinolytic enzyme, peroxidase, phospholipase, phytase, polyphenoloxidase, proteolytic enzyme, ribonuclease, transglutaminase or xylanase.

In certain embodiments that may be combined with the preceding embodiments, the fungal cell further contains reduced or no detectable activity of ALG3, a mannosyltransferase enzyme. In certain embodiments, the gene encoding ALG3 contains a mutation that reduces or eliminates the corresponding activity. In certain embodiments that may be combined with the preceding embodiments, the fungal cell further contains a polynucleotide encoding an α-1,2-mannosidase.

In certain embodiments that may be combined with the preceding embodiments, the fungal cell has a mutation that reduces the expression of a protease desired to have reduced activity. In certain embodiments that may be combined with the preceding embodiments, the mutation is a deletion within the gene encoding the protease. In certain embodiments that may be combined with the preceding embodiments, the mutation is a deletion of the portion of the gene encoding the catalytic domain of the protease. In certain embodiments that may be combined with the preceding embodiments, the fungal cell has a point mutation in the portion of the gene encoding the catalytic domain of the protease.

In other embodiments, the reduction or elimination of protease activity of one or more proteases results from RNAi constructs specific for i) one protease or ii) two or more proteases selected from the group consisting of a pep-type protease, a trypsin-like serine protease, a gap-type protease, a sedolisin protease and a sip-type protease. In certain embodiments, RNAi constructs are specific for slp2, slp3, slp5 and/or slp6.

In certain embodiments that may be combined with the preceding embodiments, the fungal cell further contains an N-acetylglucosaminyltransferase I catalytic domain and an N-acetylglucosaminyltransferase II catalytic domain. In certain embodiments, the N-acetylglucosaminyltransferase I catalytic domain and the N-acetylglucosaminyltransferase II catalytic domain are encoded by a polynucleotide. In certain embodiments, the N-acetylglucosaminyltransferase I catalytic domain is encoded by a first polynucleotide and the N-acetylglucosaminyltransferase II catalytic domain is encoded by a second polynucleotide. In certain embodiments that may be combined with the preceding embodiments, the fungal cell further contains a polynucleotide encoding a mannosidase II and/or a galactosyl transferase. In certain embodiments, the fungal cell contains enzymes selected from the group consisting of α1,2 mannosidase, N-acetylglucosaminyltransferase I, N-acetylglucosaminyltransferase II, mannosidase II and/or galactosyltransferase, said enzymes further comprising a targeting peptide, for example a heterologous targeting peptide for proper localization of the corresponding enzyme. In certain embodiments, the targeting peptide is selected from SEQ ID NOs: 589-594.

In certain embodiments that may be combined with the preceding embodiments, the fungal cell is a *Trichoderma* fungal cell, a *Myceliophthora* fungal cell, an *Aspergillus* fungal cell, a *Neurospora* fungal cell, a *Fusarium* or *Penicilium* fungal cell, or a *Chrysosporium* fungal cell. In certain embodiments that may be combined with the preceding embodiments, the fungal cell is *Trichoderma reesei*.

In certain embodiments that may be combined with the preceding embodiments, the fungal cell is wild type for pep4 protease. In certain embodiments that may be combined with the preceding embodiments, the fungal cell is wild type for tsp1 protease.

Another aspect includes methods of improving heterologous polypeptide stability, by: a) providing the filamentous fungal cell of any of the preceding embodiments; and b) culturing the cell such that the heterologous polypeptide is expressed, where the heterologous polypeptide has increased stability compared to the heterologous polypeptide produced in a corresponding parental filamentous fungal cell in which the proteases do not have reduced activity, for example, as not containing the mutations of the genes encoding the proteases. Another aspect includes methods of making a heterologous polypeptide, by: a) providing the filamentous fungal cell of any of the preceding embodiments; b) culturing the host cell such that the heterologous polypeptide is expressed; and c) purifying the heterologous polypeptide.

In certain embodiments that may be combined with the preceding embodiments, the filamentous fungal cell further contains a carrier protein. In certain embodiments, the carrier protein is CBH1. In certain embodiments that may be combined with the preceding embodiments, the culturing is in a medium comprising a protease inhibitor. In certain embodiments, the culturing is in a medium having one or two protease inhibitors selected from SBTI and chymostatin. In certain embodiments, the protease activities are reduced or eliminated according to the invention with further co-expression or co-culture such as SBTI, or BBI, e.g. as described in WO2005047302, or slp inhibitor such as pepc inhibitor as described in WO2009071530.

In certain embodiments, the heterologous polypeptide produced according to the method is a glycosylated mammalian polypeptide, preferably an antibody or their Fc glycosylated fragments, and at least 10%, at least 20%, at least 30%, at least 40%, at least 50%, at least 60%, at least 70%, at least 80%, at least 90%, or 100% (mole %) of the total N-glycans of the polypeptide consists of $Man_3GlcNAc_2$ N-glycan or Man5GlcNAc2 N-glycan. In other embodiments, the heterologous polypeptide produced according to the method is a glycosylated mammalian polypeptide, preferably an antibody or their Fc glycosylated fragments, and at least 10%, at least 20%, at least 30%, at least 40%, at least 50%, at least 60%, at least 70%, at least 80%, at least 90%, or 100% (mole %) of the total N-glycans of the polypeptide consists of complex N-glycan, such as G0, G1 or G2 glycoforms or their fucosylated forms, FG0, FG1 and FG2. In certain embodiments, the heterologous polypeptide produced according to the method is a glycosylated mammalian polypeptide, preferably an antibody or their Fc glycosylated fragments, and at least 10%, at least 20%, at least 30%, at least 40%, at least 50%, at least 60%, at least 70%, at least 80%, at least 90%, or 100% (mole %) of the total N-glycans of the polypeptide consists of hybrid N-glycan. In certain embodiments, the heterologous polypeptide produced according to the method is a glycosylated mammalian polypeptide, preferably an antibody or their Fc glycosylated fragments, and at least 10%, at least 20%, at least 30%, at least 40%, at least 50%, at least 60%, at least 70%, at least 80%, at least 90%, or 100% (mole %) of the total N-glycans of the polypeptide consists of G1 or G2 N-glycan. Another aspect includes the heterologous polypeptides, preferably an antibody or their Fc glycosylated fragments, obtainable by the methods as described above.

Another aspect includes *Trichoderma* fungal cells, or closely related species, including *Myceliophthora* fungal cell, *Aspergillus* fungal cell, *Neurospora* fungal cell, *Penicillium* cell, *Fusarium* cell, or *Chrysosporium* fungal cell, said fungal cell having reduced or no detectable activity of at least three proteases selected from pep1, pep2, pep3, pep4, pep5, tsp1, slp1, slp2, gap1, and gap2, where the cell further contains a recombinant polynucleotide encoding a mammalian polypeptide produced at a level of at least 2-fold higher than the production level of the polypeptide in a corresponding parental fungal cell.

In certain embodiments that may be combined with the preceding embodiments, the *Trichoderma* or closely related species fungal cell, further contains reduced or no detectable activity of one or more of the following proteases: pep9, amp1, amp2 and sep1.

In certain embodiments, the expression level of the at least three proteases is reduced or eliminated in the *Trichoderma* or closely related species fungal cell. In certain embodiments, genes encoding the at least three proteases each comprise a mutation that reduces or eliminates the corresponding protease activity in the *Trichoderma* or closely related species cell. In certain embodiments, the *Trichoderma* or closely related species fungal cell includes three protease encoding genes with a mutation that reduces or eliminates protease activity, which are selected from gap1, slp1, and pep1. In certain embodiments that may be combined with the preceding embodiments, the mammalian polypeptide in the *Trichoderma* or closely related species fungal cell is an antibody, or their antigen-binding fragments, or an immunoglobulin, and the at least three proteases are selected from pep1, pep3, pep4, tsp1, slp1, slp2, gap1, and gap2. In certain embodiments, the *Trichoderma* or closely related species fungal cell contains four protease encoding genes, each of which comprise a mutation that reduces or eliminates the corresponding protease activity, and the four protease encoding genes with such mutation are pep1, tsp1, slp1, and gap1. In certain embodiments, the *Trichoderma* or closely related species fungal cell has five protease encoding genes, each of which comprise a mutation that reduces or eliminates the corresponding protease activity, and the five protease encoding genes with such mutation are pep1, tsp1, slp1, gap1, and pep4. In certain embodiments that may be combined with the preceding embodiments, the mammalian polypeptide in the *Trichoderma* fungal cell is a growth factor, interferon, cytokine, or interleukin, and the three proteases with reduced activity are selected from pep1, pep2, pep3, pep4, pep5, pep8, pep11, pep12, gap1, gap2, slp1, slp2, slp7, and, optionally tsp1. In certain embodiments, the *Trichoderma* or closely related species fungal cell has five protease encoding genes, each of which comprise a mutation that reduces or eliminates the corresponding protease activity, and the five protease encoding genes with such mutation are pep1, tsp1, slp1, gap1, and gap2. In certain embodiments, the *Trichoderma* or closely related species fungal cell has six protease encoding genes, each of which comprise a mutation that reduces or eliminates the corresponding protease activity, and the six protease encoding genes with such mutation are pep1, tsp1, slp1, gap1, gap2, and pep4. In certain embodiments that may be combined with the preceding embodiments, the *Trichoderma* or closely related species fungal cell has seven protease encoding genes, each of which comprise a mutation that reduces or eliminates the corresponding protease activity, and the seven protease encoding genes are pep1, tsp1, slp1, gap1, gap2, pep4, and pep3. In certain embodiments that may be combined with the preceding embodiments, the *Trichoderma* or closely related species fungal cell has eight protease encoding genes, each of which comprise a mutation that reduces the corresponding protease activity, and the eight protease encoding genes with such mutation are pep1, tsp1, slp1, gap1, gap2, pep4, pep3, and pep5. In certain embodiments that may be combined with the preceding embodiments, the *Trichoderma* or closely related species fungal cell has eight protease encoding genes, each of which comprise a mutation that reduces the corresponding protease activity, and the eight protease encoding genes with such mutation are selected from either (i) pep1, slp1, gap1, gap2, pep4, pep3, pep5, amp1;
(ii) pep1, slp1, gap1, gap2, pep4, pep3, pep5, amp2;
(iii) pep1, slp1, gap1, gap2, pep4, pep3, pep5, sep1;
(iv) pep1, slp1, gap1, gap2, pep4, pep3, pep5, pep9; or,
(v) pep1, slp1, gap1, gap2, pep4, pep3, pep5, pep2

In such embodiment, the cell may further comprise an additional mutation that reduces or eliminates the protease activity of tsp1.

In certain embodiments that may be combined with the preceding embodiments, the *Trichoderma* or closely related species fungal cell has nine protease encoding genes, each of which comprise a mutation that reduces the corresponding protease activity, and the nine protease encoding genes with such mutation are pep1, slp1, gap1, gap2, pep4, pep3, pep5, pep2, sep1. In such embodiment, the cell may further comprise an additional mutation that reduces or eliminates the protease activity of tsp1.

In certain embodiments that may be combined with the preceding embodiments, the *Trichoderma* or closely related species fungal cell has ten protease encoding genes, each of which comprise a mutation that reduces the corresponding protease activity, and the ten protease encoding genes with such mutation are pep1, slp1, gap1, gap2, pep4, pep3, pep5, pep2, sep1, slp8. In such embodiment, the cell may further comprise an additional mutation that reduces or eliminates the protease activity of tsp1.

In certain embodiments that may be combined with the preceding embodiments, the *Trichoderma* or closely related species fungal cell has eleven protease encoding genes, each of which comprise a mutation that reduces the corresponding protease activity, and the eleven protease encoding genes with such mutation are pep1, slp1, gap1, gap2, pep4, pep3, pep5, pep2, sep1, slp8, amp2. In such embodiment, the cell may further comprise an additional mutation that reduces or eliminates the protease activity of tsp1.

In certain embodiments that may be combined with the preceding embodiments, the *Trichoderma* or closely related species fungal cell has twelve protease encoding genes, each of which comprise a mutation that reduces the corresponding protease activity, and the twelve protease encoding genes with such mutation are pep1, slp1, gap1, gap2, pep4, pep3, pep5, pep2, sep1, slp8, amp2, slp7.

In certain embodiments that may be combined with the preceding embodiments, the *Trichoderma* or closely related species fungal cell has reduced or no protease activity in at least thirteen proteases, each of the genes encoding the thirteen proteases comprises a mutation that reduces or eliminates the corresponding protease activity, and the thirteen proteases are either pep1, tsp1, slp1, gap1, gap2, pep4, pep3, pep5, pep2, sep1, slp8, amp2, pep9;

pep1, tsp1, slp1, gap1, gap2, pep4, pep3, pep5, pep2, sep1, slp8, amp2, slp7;

pep1, tsp1, slp1, gap1, gap2, pep4, pep3, pep5, pep2, sep1, slp8, amp2, slp3.

In certain embodiments that may be combined with the preceding embodiments, the *Trichoderma* or closely related species fungal cell has reduced or no protease activity in at least fourteen proteases, each of the genes encoding the fourteen proteases comprises a mutation that reduces or eliminates the corresponding protease activity, and the fourteen proteases are pep1 tsp1 slp1 gap1 gap2 pep4 pep3 pep5 pep2 sep1 slp8 amp2 pep9 slp2;

In certain embodiments that may be combined with the preceding embodiments, the *Trichoderma* or closely related species fungal cell has reduced or no protease activity in at least fifteen proteases, each of the genes encoding the fifteen proteases comprises a mutation that reduces or eliminates the corresponding protease activity, and the fifteen proteases are either pep1 tsp1 slp1 gap1 gap2 pep4 pep3 pep5 pep2 sep1 slp8 amp2 pep9 slp2 mp1; or, pep1 tsp1 slp1 gap1 gap2 pep4 pep3 pep5 pep2 sep1 slp8 amp2 pep9 slp2 mp5.

In certain embodiments that may be combined with the preceding embodiments, the *Trichoderma* or closely related species fungal cell further contains reduced or no detectable activity of one or more additional proteases. In certain embodiments, the expression level of the one or more additional proteases in the *Trichoderma* or closely related species fungal cell is reduced or eliminated. In certain embodiments, genes encoding the one or more additional protease in the *Trichoderma* or closely related species fungal cell each have a mutation that reduces or eliminates the corresponding protease activity. In certain embodiments that may be combined with the preceding embodiments, the one or more additional protease encoding genes are selected from pep7, pep8, pep11, pep12, tpp1, gap2, slp3, slp5, slp6, slp7, and slp8. In certain embodiments that may be combined with the preceding embodiments, the one or more additional protease encoding genes are selected from the group consisting of an aspartic protease pep6, pep10, pep13, pep14, or pep16;

slp like protease slp57433, slp35726, slp60791, or slp109276;

gap like protease gap3 or gap4;

sedolisin like protease sed2, sed3, or sed5;

Group A protease selected from the group of protease65735, protease77577, protease81087, protease56920, protease122083, protease79485, protease120998, or protease61127;

Group B protease selected from the group of protease21659, protease58387, protease75159, protease56853, or protease64193;

Group C protease selected from the group of protease82452, protease80762, protease21668, protease81115, protease82141, protease23475;

Group D protease selected from the group of protease121890, protease22718, protease47127, protease61912, protease80843, protease66608, protease72612, protease40199; or Group E protease selected from the group of protease22210, protease111694, protease82577.

In certain embodiments that may be combined with the preceding embodiments, the *Trichoderma* or closely related species fungal cell further contains reduced or no detectable activity of ALG3. In certain embodiments, the gene encoding ALG3 in the *Trichoderma* or closely related species fungal cell contains a mutation that reduces or eliminates the corresponding activity. In certain embodiments that may be combined with the preceding embodiments, the *Trichoderma* or closely related species fungal cell further contains a polynucleotide encoding an α-1,2-mannosidase. In certain embodiments that may be combined with the preceding embodiments, the mutation reduces or eliminates the expression of the gene in the *Trichoderma* or closely related species fungal cell. In certain embodiments that may be combined with the preceding embodiments, the mutation is a deletion of the gene in the *Trichoderma* or closely related species fungal cell. In certain embodiments that may be combined with the preceding embodiments, the mutation is a deletion of the portion of the gene encoding the catalytic domain of the protease in the *Trichoderma* or closely related species fungal cell. In certain embodiments that may be combined with the preceding embodiments, the mutation is a point mutation in the portion of the gene encoding the catalytic domain of the protease in the *Trichoderma* or closely related species fungal cell. In certain embodiments that may be combined with the preceding embodiments, the *Trichoderma* or closely related species fungal cell further contains a N-acetylglucosaminyltransferase I catalytic domain and an N-acetylglucosaminyltransferase II catalytic domain. In certain embodiments, the N-acetylglucosaminyltransferase I catalytic domain and the N-acetylglucosaminyltransferase II catalytic domain are encoded by a polynucleotide of the *Trichoderma* or closely related species fungal cell. In certain embodiments, the N-acetylglucosaminyltransferase I catalytic domain is encoded by a first polynucleotide and the N-acetylglucosaminyltransferase II catalytic domain is encoded by a second polynucleotide of the *Trichoderma* or closely related species fungal cell. In certain embodiments that may be combined with the preceding embodiments, the *Trichoderma* fungal cell further contains a polynucleotide encoding a mannosidase II. In certain embodiments, the proteases each have at least 70%, at least 75%, at least 80%, at least 85%, at least 90%, at least 95%, at least 96%, at least 97%, at least 98%, at least 99%, or 100% sequence identity to an amino acid sequence selected from SEQ ID NOs: 1, 17, 37, 58, 66, 82, 98, 118, 129, 166, and 182. In certain embodiments, the total protease activity in the *Trichoderma* fungal cell is reduced to 49% or less, 40% or less, 31% or less, 6% or less of the total protease activity of the corresponding *Trichoderma* parental cell in which the proteases do not have the reduced activity. In certain embodiments that may be combined with the preceding embodiments, the cell further contains a recombinant polynucleotide encoding a mammalian polypeptide produced at a level of at least 2-fold higher than the production level of the polypeptide in a corresponding parental *Trichoderma* fungal cell. In certain embodiments that may be combined with the preceding embodiments, the mammalian polypeptide is produced in a full length version at a level higher than the production level of the full-length version of the polypeptide in a corresponding parental *Trichoderma* fungal cell.

Another aspect includes methods of improving heterologous polypeptide stability, by: a) providing the *Trichoderma* fungal cell of any of the preceding embodiments; and b) culturing the cell such that the heterologous polypeptide is expressed, where the heterologous polypeptide has increased stability compared to a host cell not containing the mutations of the genes encoding the proteases. Another aspect includes methods of making a heterologous polypeptide, e.g. an immunoglobulin or antibody or their glycosylated Fc fragments, by: a) providing the *Trichoderma* or closely related species fungal cell of any of the preceding embodiments; b) culturing the host cell such that the heterologous polypeptide is expressed; and c) purifying the heterologous polypeptide. In certain embodiments that may be combined with the preceding embodiments, the filamentous fungal cell further contains a carrier protein. In certain embodiments, the carrier protein is CBH1.

DETAILED DESCRIPTION

Figure 1:
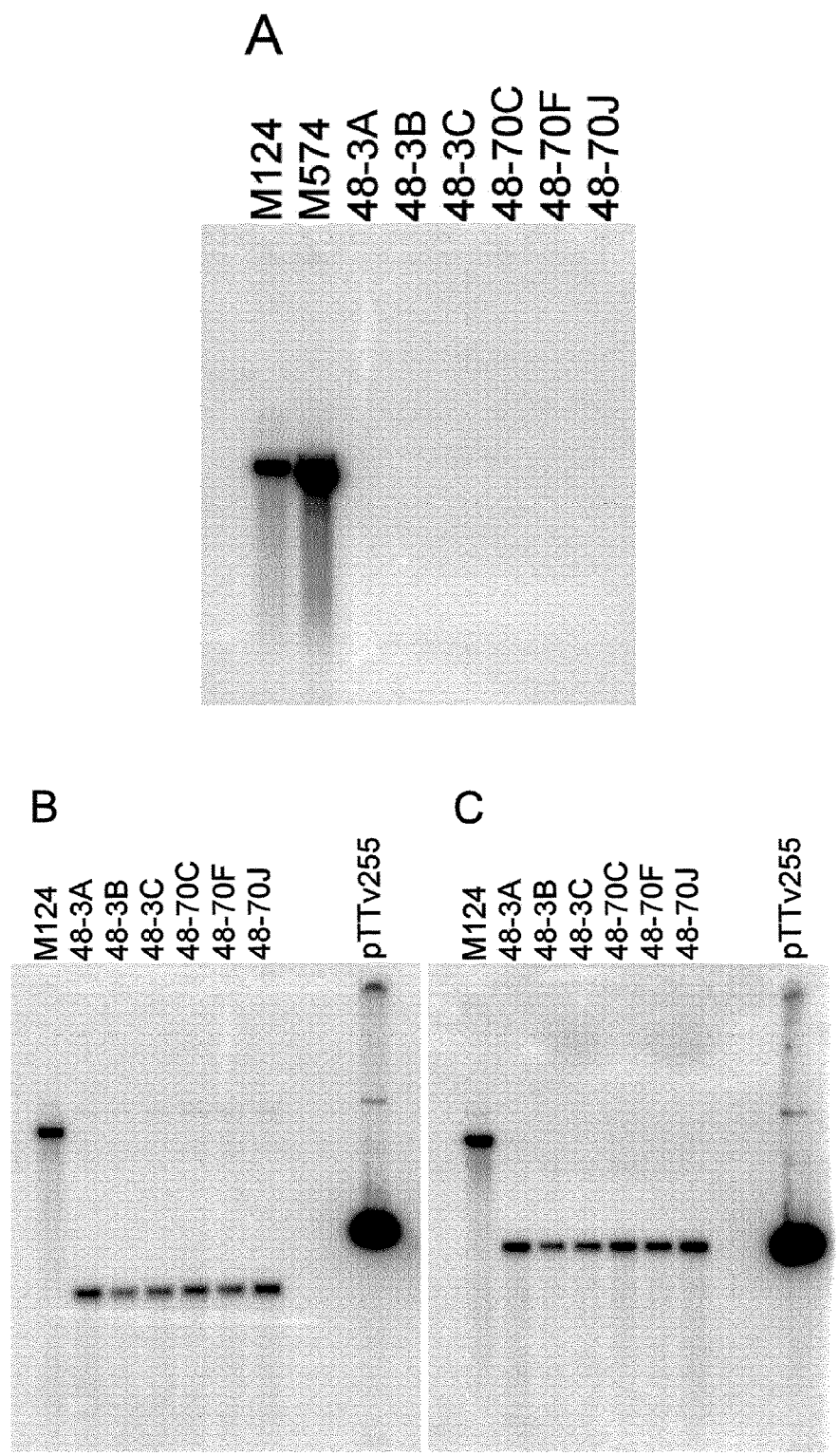
FIG. 1 depicts Southern blot analysis showing the generation of the 10-fold protease deletion strain M633 (48-70C; M659 is repurified M633). Figure A depicts the expected signal of sep1 ORF: 7.5 kb from M124 (Δ0) and M574 (Δ9), no signal from the transformants. Figure B depicts the expected signal of sep1 5' flank: 7.5 kb from M124, 3.1 kb from transformants, 3.9 kb from pTTv255. Figure C depicts the expected signal of sep1 3' flank: 7.5 kb from M124, 3.9 kb from transformants, 3.9 kb from pTTv255.

The present invention relates to improved methods of generating recombinant heterologous polypeptides in filamentous fungal cells that have reduced or no activity of at least three proteases. The present invention further relates to improved methods of generating recombinant heterologous polypeptides in filamentous fungal cells that have reduced or no activity in one or more of the following proteases: pep9, amp1, amp2 and sep1. The present invention is based in part upon the surprising discovery that reducing the activity of a specific combination of endogenous proteases in filamentous fungal cells increases the expression and stability of a variety of recombinantly expressed heterologous proteins, such as immunoglobulins and growth factors. While others have created *Trichoderma* fungal cells with one or more proteases inactivated, they have not provided guidance as to which proteases are most relevant to increasing the expression and stability of specific types of proteins, such as mammalian proteins. For example, WO2011/075677 discloses certain proteases that can be knocked out in *Trichoderma* and even discloses *Trichoderma* fungal cells that are deficient in multiple proteases.

However, WO2011/075677 does not provide any guidance regarding which of the proteases have an adverse impact on the expression and stability of mammalian proteins, such as immunoglobulins or growth factors, as no examples of expression of any mammalian proteins are described therein. Moreover, WO2011/075677 only discloses heterologous expression of a single fungal protein in each of three different fungal strains deficient in a single protease. Thus, one of skill in the art would likely read WO2011/075677 as teaching that inactivating each single protease would be sufficient for heterologous protein production. Yoon et al (2009, Appl. Microbiol Biotechnol 82: 691-701, 2010: Appl. Microbiol Biotechnol DOI 10.1007/s00253-010-2937-0) reported the construction of quintuple and ten fold protease gene disruptants for heterologous protein production in *Aspergillus oryzae*. The 10 protease disruptant cells improve the production yield of chymosin by only 3.8 fold, despite the high number of disrupted protease genes. Van den Hombergh et al reported a triple protease gene disruptant of *Aspergillus niger*. While the data show a reduction in protease activity, there is no example of any mammalian protein production described herein. WO2002068623 further report *Aspergillus niger* amp1, sep1 and pep9 proteases, and WO2012048334 reports *Myceliophtora thermophila* amp2, sep1 and pep9 proteases. Other reports describe the cloning and characterization of sep1 protease in filamentous fungal strains (WO2011077359, WO2009144269, WO200762936 and WO2002045524). The cloning and characterization of pep9 has also been described in WO2012032472, and WO2006110677.

Applicants have surprisingly shown that multiple proteases are relevant to reduction of total protease activity, increasing production of heterologous proteins and stabilizing the heterologous proteins after expression, in filamentous fungal cells, such as *Trichoderma* fungal cells. In particular, the inventors have identified proteases that are actually expressed in *Trichoderma* fungal cells (as opposed to merely being coded for in the genome) by purifying these proteases and determining which have activities that are most relevant in degrading heterologous proteins, such as mammalian proteins. Additionally, the inventors confirmed that deleting the genes responsible for the particular protease activities achieved a substantial reduction in total protease activity, which correlates to an increase in protein stabilization in terms of both quantity and quality of proteins produced in filamentous fungal cells containing such deletions, and resulted in an increase in the production of full length heterologous proteins in the cells. It was also found that *Trichoderma* fungal cells engineered to reduce the activity of at least three protease genes resulted in an unexpected, synergistic increase in the production of full length mammalian proteins, such as antibodies, therapeutic protein or antibody variants such Fab or single domain antibodies. In other words, the amount of full length mammalian protein produced was greater than the sum of the amounts produced in *Trichoderma* fungal cells containing only one or two protease gene deletions. Thus, in contrast to WO2011/075677, the inventors have shown that production of intact heterologous proteins in filamentous fungal cells, such as *Trichoderma* fungal cells, can be achieved by reducing or eliminating the activity of at least three proteases in the cells.

Accordingly, certain aspects of the present disclosure provide filamentous fungal cells that produce increased levels of a heterologous protein by having reduced or no activity of at least three proteases, where the cell further contains a recombinant polynucleotide encoding a heterologous polypeptide produced at a level of at least 2-fold higher than the production level of the polypeptide in a corresponding parental filamentous fungal cell in which the proteases do not have the reduced activity. In other words, the desired increase in the level of the heterologous protein production is determinable by comparing the production level of the heterologous protein in a filamentous fungal cell having the reduced activity of at least three proteases, to that of a filamentous fungal cell which does not have such reduced activity, but is otherwise identical to the cell exhibiting the increased level.

Other aspects of the present disclosure provide methods of improving heterologous polypeptide stability, by: a) providing a filamentous fungal cell of the present disclosure having reduced or no activity of at least three proteases, where the cell further contains a recombinant polynucleotide encoding a heterologous polypeptide; and b) culturing the cell such that the heterologous polypeptide is expressed, where the heterologous polypeptide has increased stability compared to a host cell not containing the mutations of the genes encoding the proteases.

Still other aspects of the present disclosure provide methods of making a heterologous polypeptide, by: a) providing a filamentous fungal cell of the present disclosure having reduced or no activity of at least three proteases, where the cell further contains a recombinant polynucleotide encoding a heterologous polypeptide; b) culturing the host cell such that the heterologous polypeptide is expressed; and c) purifying the heterologous polypeptide.

Certain aspects of the present disclosure also provide *Trichoderma* fungal cells that produce increased levels of a mammalian polypeptide by having reduced or no activity of at least three proteases selected from pep1, pep2, pep3, pep4, pep5, pep8, pep11, pep12, tsp1, slp1, slp2, gap1, and gap2, where the cell further contains a recombinant polynucleotide encoding a mammalian polypeptide produced at a level of at least 2-fold higher than the production level of the polypeptide in a corresponding parental *Trichoderma* fungal cell in which the proteases do not have the reduced activity. In other words, the desired increase in the level of the heterologous protein production is determinable by comparing the production level of the heterologous protein in a *Trichoderma* fungal cell having the reduced activity of at least three proteases, to that of a *Trichoderma* fungal cell which does not have such reduced activity, but is otherwise identical to the cell exhibiting the increased level.

Certain aspects of the present disclosure also provide *Trichoderma* fungal cells that produce increased levels of a mammalian polypeptide by having reduced or no activity of at least one or more proteases selected from pep9, amp1, amp2, mp1, mp2, mp3, mp4, mp5 and sep1.

Other aspects of the present disclosure provide methods of improving mammalian polypeptide stability, by: a) providing a *Trichoderma* fungal cell of the present disclosure having reduced activity of at least three proteases, where the cell further contains a recombinant polynucleotide encoding a mammalian polypeptide; and b) culturing the cell such that the mammalian polypeptide is expressed, where the mammalian polypeptide has increased stability compared to a host cell not containing the mutations of the genes encoding the proteases.

Other aspects of the present disclosure provide methods of improving mammalian polypeptide stability, by: a) providing a *Trichoderma* fungal cell of the present disclosure having reduced activity of at least one or more proteases selected from pep9, amp1, amp2, mp1, mp2, mp3, mp4, mp5 and sep1, where the cell further contains a recombinant polynucleotide encoding a mammalian polypeptide; and b) culturing the cell such that the mammalian polypeptide is expressed, where the mammalian polypeptide has increased stability compared to a host cell not containing the mutations of the genes encoding the proteases.

Further aspects of the present disclosure provide methods of making a mammalian polypeptide, by: a) providing a *Trichoderma* fungal cell of the present disclosure having reduced activity of at least three protease, where the cell further contains a recombinant polynucleotide encoding a mammalian polypeptide; b) culturing the host cell such that the mammalian polypeptide is expressed; and c) purifying the mammalian polypeptide.

Definitions

As used herein, an "immunoglobulin" refers to a multimeric protein containing a heavy chain and a light chain covalently coupled together and capable of specifically combining with antigen. Immunoglobulin molecules are a large family of molecules that include several types of molecules such as IgM, IgD, IgG, IgA, and IgE.

As used herein, an "antibody" refers to intact immunoglobulin molecules, as well as fragments thereof which are capable of binding an antigen. These include hybrid (chimeric) antibody molecules (see, e.g., Winter et al. *Nature* 349:293-99225, 1991; and U.S. Pat. No. 4,816,567 226); F(ab')2 and F(ab) fragments and Fv molecules; non-covalent heterodimers [227, 228]; single-chain Fv molecules (scFv) (see, e.g., Huston et al. *Proc. Natl. Acad. Sci. U.S.A.* 85:5897-83, 1988); dimeric and trimeric antibody fragment constructs; minibodies (see, e.g., Pack et al. *Biochem* 31, 1579-84, 1992; and Cumber et al. *J. Immunology* 149B, 120-26, 1992); humanized antibody molecules (see e.g., Riechmann et al. *Nature* 332, 323-27, 1988; Verhoeyan et al. *Science* 239, 1534-36, 1988; and GB 2,276,169); and any functional fragments obtained from such molecules, as well as antibodies obtained through non-conventional processes such as phage display. Preferably, the antibodies are monoclonal antibodies. Methods of obtaining monoclonal antibodies are well known in the art.

As used herein, a "peptide" and a "polypeptide" are amino acid sequences including a plurality of consecutive polymerized amino acid residues. For purpose of this invention, typically, peptides are those molecules including up to 50 amino acid residues, and polypeptides include more than 50 amino acid residues. The peptide or polypeptide may include modified amino acid residues, naturally occurring amino acid residues not encoded by a codon, and non-naturally occurring amino acid residues. As used herein, "protein" may refer to a peptide or a polypeptide of any size.

Proteases of the Invention

The invention described herein relates to filamentous fungal cells, such as *Trichoderma* fungal cells, that produce increased levels of a heterologous polypeptide, such as a mammalian polypeptide, by having reduced or no detectable activity of at least three proteases found in the cells. Such proteases found in filamentous fungal cells that express a heterologous polypeptide normally catalyze significant degradation of the expressed recombinant polypeptides. Thus, by reducing or eliminating the activity of proteases in filamentous fungal cells that express a heterologous polypeptide, the stability of the expressed polypeptide is increased, resulting in an increased level of production of the polypeptide, and in some circumstances, improved quality of the produced polypeptide (e.g., full-length instead of degraded).

Proteases including, without limitation, aspartic proteases, trypsin-like serine proteases, subtilisin proteases, glutamic proteases, metalloproteases and sedolisin proteases. Such proteases may be identified and isolated from filamentous fungal cells and tested to determine whether reduction in their activity affects the production of a recombinant polypeptide from the filamentous fungal cell. Methods for identifying and isolating proteases are well known in the art, and include, without limitation, affinity chromatography, zymogram assays, and gel electrophoresis. An identified protease may then be tested by deleting the gene encoding the identified protease from a filamentous fungal cell that expresses a recombinant polypeptide, such a heterologous or mammalian polypeptide, and determining whether the deletion results in a decrease in total protease activity of the cell, for example, to a level of 49% or less, or 31% or less, of the total protease activity of the corresponding parental filamentous fungal cell; and an increase in the level of production of the expressed recombinant polypeptide, for example two-fold higher than the production level in the corresponding parental filamentous fungal cell. Methods for deleting genes, measuring total protease activity, and measuring levels of produced protein are well known in the art and include the methods described herein. The "corresponding parental filamentous fungal cell" refers to the corresponding cell in which the proteases do not have reduced or eliminated activity.

Aspartic Proteases

Aspartic proteases are enzymes that use an aspartate residue for hydrolysis of the peptide bonds in polypeptides and proteins. Typically, aspartic proteases contain two highly-conserved aspartate residues in their active site which are optimally active at acidic pH. Aspartic proteases from eukaryotic organisms such as *Trichoderma* fungi include pepsins, cathepsins, and renins. Such aspartic proteases have a two-domain structure, which is thought to arise from an ancestral gene duplication. Consistent with such a duplication event, the overall fold of each domain is similar, though the sequences of the two domains have begun to diverge. Each domain contributes one of the catalytic aspartate residues. The active site is in a cleft formed by the two domains of the aspartic proteases. Eukaryotic aspartic proteases further include conserved disulfide bridges, which can assist in identification of the polypeptides as being aspartic acid proteases.

Fifteen aspartic proteases have been identified in *Trichoderma* fungal cells: pep1 (tre74156), pep2 (tre53961), pep3 (tre121133), pep4 (tre77579), pep5 (tre81004), pep6 (tre68662), pep7 (tre58669), pep8 (tre122076), pep9 (tre79807), pep10 (tre78639), pep11 (tre121306), pep12 (tre119876), pep13 (tre76887), pep14 (tre108686) and pep16 (tre110490).

Pep1

Examples of suitable pep1 proteases include, without limitation, *Trichoderma reesei* pep1 (SEQ ID NO: 1), *Hypocrea lixii* gi|11558498 (SEQ ID NO: 2), *Trichoderma asperellum* gi|47027997 (SEQ ID NO: 3), *Trichoderma atroviride* jgi|Triat2|297887 (SEQ ID NO: 4), *Trichoderma virens* jgi|TriviGv29_8_2|81777 (SEQ ID NO: 5), *Aspergillus fumigatus* jgi|Trire2|afm:Afu5g13300 (SEQ ID NO: 6), *Aspergillus oryzae* gi|94730408 (SEQ ID NO: 7), *Metarhizium anisopliae* gi|322712783 (SEQ ID NO: 8), *Gibberella zeae* gi|46126795 (SEQ ID NO: 9), *Fusarium venenatum* gi|18448713 (SEQ ID NO: 10), *Fusarium oxysporum* gi|342879173 (SEQ ID NO: 11), *Grosmannia clavigera* gi|320591399 (SEQ ID NO: 12), *Verticillium alboatrum* gi|302422750 (SEQ ID NO: 13), *Chaetomium globosum* gi|116182964 (SEQ ID NO: 14), *Neurospora crassa* gi|85110723 (SEQ ID NO: 15), *Neurospora tetrasperma* gi|336463990 (SEQ ID NO: 16), *Myceliophthora thermophila* gi367030924 (SEQ ID NO: 491), *Penicillium chrysogenum* gi255953325 (SEQ ID NO: 492), *Aspergillus niger* gi350639535 (SEQ ID NO: 493), *Aspergillus nidulans* gi67541436 (SEQ ID NO: 494), and homologs thereof.

Accordingly, in certain embodiments, a protease of the present disclosure, typically a pep1 protease, has an amino acid sequence having 50% or more identity (e.g. 60%, 65%, 70%, 75%, 80%, 85%, 90%, 91%, 92%, 93%, 94%, 95%, 96%, 97%, 98%, 99%, 99.5% or more to an amino acid sequence selected from SEQ ID NOs: 1-16, SEQ ID NOs: 491-494. In some embodiments, the protease has 100% identity to an amino acid sequence selected from SEQ ID NOs: 1-16, SEQ ID NOs:491-494.

In some embodiments, pep1 is *T. reesei* pep1. The amino acid sequence encoded by *T. reesei* pep1 is set forth in SEQ ID NO: 1. In other embodiments, a protease of the present disclosure has an amino acid sequence having 50% or more identity (e.g. 60%, 65%, 70%, 75%, 80%, 85%, 90%, 91%, 92%, 93%, 94%, 95%, 96%, 97%, 98%, 99%, 99.5% or more) to SEQ ID NO: 1. In further embodiments, the protease has 100% identity to SEQ ID NO: 1.

Pep2

Examples of suitable pep2 proteases include, without limitation, *Trichoderma reesei* pep2 (SEQ ID NO: 182), *T atroviride* jgi|Triat2|142040 (SEQ ID NO: 183), *T virens* jgi|TriviGv29_8_2|53481 (SEQ ID NO: 184), *Cordyceps militaris* CM01 gi|346326575 (SEQ ID NO: 185), *Neurospora crassa* gi 85111370 (SEQ ID NO: 495), and homologs thereof.

Accordingly, in certain embodiments, a protease of the present disclosure, typically a pep2 protease, has an amino acid sequence having 50% or more identity (e.g. 60%, 65%, 70%, 75%, 80%, 85%, 90%, 91%, 92%, 93%, 94%, 95%, 96%, 97%, 98%, 99%, 99.5% or more to an amino acid sequence selected from SEQ ID NOs: 182-185, SEQ ID NO:495. In some embodiments, the protease has 100% identity to an amino acid sequence selected from SEQ ID NOs: 182-185, SEQ ID NO:495.

In some embodiments, pep2 is *T. reesei* pep2. The amino acid sequence encoded by *T. reesei* pep2 is set forth in SEQ ID NO: 182. In other embodiments, a protease of the present disclosure has an amino acid sequence having 50% or more identity (e.g. 60%, 65%, 70%, 75%, 80%, 85%, 90%, 91%, 92%, 93%, 94%, 95%, 96%, 97%, 98%, 99%, 99.5% or more) to SEQ ID NO: 182. In further embodiments, the protease has 100% identity to SEQ ID NO: 182.

Pep3

Examples of suitable pep3 proteases include, without limitation, *Trichoderma reesei* pep3 (SEQ ID NO: 17), *T atroviride* jgi|Triat2 (SEQ ID NO: 18), *T virens*, jgi|TriviGv29_8_2 (SEQ ID NO: 19), *Hypocrea lixii* gi|145583125 (SEQ ID NO: 20), *Trichoderma asperellum* gi|51860175 (SEQ ID NO: 21), *Aspergillus niger* gi|317025164 (SEQ ID NO: 22), *Aspergillus fumigatus* gi|159122534 (SEQ ID NO: 23), *Aspergillus niger* gi|134054572 (SEQ ID NO: 24), *Cordyceps militaris*, gi|346318620 (SEQ ID NO: 25), *Glomerella graminicola* gi|310800156 (SEQ ID NO: 26), *Fusarium oxysporum* gi|342871221 (SEQ ID NO: 27), *Grosmannia clavigera* gi|320591121 (SEQ ID NO: 28), *Botryotinia fuckeliana* gi|12002205 (SEQ ID NO: 29), *Thielavia terrestris* gi|346997107 (SEQ ID NO: 30), *Sclerotinia sclerotiorum* gi|156055954 (SEQ ID NO: 31), *Chaetomium globosum* gi|116197829 (SEQ ID NO: 32), *Neurospora tetrasperma* gi|336472132 (SEQ ID NO: 33), *Neurospora crassa* gi|85102020 (SEQ ID NO: 34), *Neosartorya fischeri* gi|119467426 (SEQ ID NO: 35), *Penicillium marneffei* gi|212534792 (SEQ ID NO: 36), *M. thermophila* gi367025909 (SEQ ID NO: 496), *P. chrysogenum* gi255947264 (SEQ ID NO: 497), *A. oryzae* 391870123 (SEQ ID NO: 498), and homologs thereof.

Accordingly, in certain embodiments, a protease of the present disclosure, typically a pep3 protease, has an amino acid sequence having 50% or more identity (e.g. 60%, 65%, 70%, 75%, 80%, 85%, 90%, 91%, 92%, 93%, 94%, 95%, 96%, 97%, 98%, 99%, 99.5% or more to an amino acid sequence selected from SEQ ID NOs: 17-36, SEQ ID NOs:496-498. In some embodiments, the protease has 100% identity to an amino acid sequence selected from SEQ ID NOs: 17-36, SEQ ID NOs: 496-498.

In some embodiments, pep3 is *T. reesei* pep3. The amino acid sequence encoded by *T. reesei* pep3 is set forth in SEQ ID NO: 17. In other embodiments, a protease of the present disclosure has an amino acid sequence having 50% or more identity (e.g. 60%, 65%, 70%, 75%, 80%, 85%, 90%, 91%, 92%, 93%, 94%, 95%, 96%, 97%, 98%, 99%, 99.5% or more) to SEQ ID NO: 17. In further embodiments, the protease has 100% identity to SEQ ID NO: 17.

Pep4

Examples of suitable pep4 proteases include, without limitation, *Trichoderma reesei* pep4 (SEQ ID NO: 37), *T virens* jgi|TriviGv29_8_2 (SEQ ID NO: 38), *T atroviride* jgi|Triat2 (SEQ ID NO: 39), *Trichoderma aureoviride* gi|193735605 (SEQ ID NO: 40), *Aspergillus niger* gi|145232965 (SEQ ID NO: 41), *Aspergillus fumigatus* gi|70999520 (SEQ ID NO: 42), *Aspergillus clavatus* gi|121705756 (SEQ ID NO: 43), *Nectria haematococca* gi|302899226 (SEQ ID NO: 44), *Glomerella graminicola* gi|310796316 (SEQ ID NO: 45), *Cordyceps militaris* gi|346322842 (SEQ ID NO: 46), *Gibberella zeae* gi|46138535 (SEQ ID NO: 47), *Metarhizium anisopliae* gi|322708430 (SEQ ID NO: 48), *Fusarium oxysporum* gi|342882947 (SEQ ID NO: 49), *Metarhizium acridum* gi|322700747 (SEQ ID NO: 50), *Verticillium dahliae*, gi|346973691 (SEQ ID NO: 51), *Botryotinia fuckeliana* gi|154309857 (SEQ ID NO: 52), *Chaetomium globosum* gi|116203505 (SEQ ID NO: 53), *Thielavia terrestris* gi|347001590 (SEQ ID NO: 54), *Magnaporthe oryzae* gi|39973863 (SEQ ID NO: 55), *Tuber melanosporum* gi|296417651 (SEQ ID NO: 56), *Neurospora crassa* gi|85094599 (SEQ ID NO: 57), *M. thermophila* gi367031892 gi255947264 (SEQ ID NO: 499), *P. chrysogenum* gi255936729 gi255947264 (SEQ ID NO: 500), *A. oryzae* gi169770745 gi255947264 (SEQ ID NO: 501), *A. nidulans* gi67524891 gi255947264 (SEQ ID NO: 502), and homologs thereof.

Accordingly, in certain embodiments, a protease of the present disclosure, typically a pep4 protease, has an amino acid sequence having 50% or more identity (e.g. 60%, 65%, 70%, 75%, 80%, 85%, 90%, 91%, 92%, 93%, 94%, 95%, 96%, 97%, 98%, 99%, 99.5% or more to an amino acid sequence selected from SEQ ID NOs: 37-57, SEQ ID NOs:499-502. In some embodiments, the protease has 100% identity to an amino acid sequence selected from SEQ ID NOs: 37-57, SEQ ID NOs:499-502.

In some embodiments, pep4 is *T. reesei* pep4. The amino acid sequence encoded by *T. reesei* pep4 is set forth in SEQ ID NO: 37. In other embodiments, a protease of the present disclosure has an amino acid sequence having 50% or more identity (e.g. 60%, 65%, 70%, 75%, 80%, 85%, 90%, 91%, 92%, 93%, 94%, 95%, 96%, 97%, 98%, 99%, 99.5% or more) to SEQ ID NO: 37. In further embodiments, the protease has 100% identity to SEQ ID NO: 37.

Pep5

Examples of suitable pep5 genes include, without limitation, *Trichoderma reesei* pep5 (SEQ ID NO: 58), *T virens* jgi|TriviGv29_8_2 (SEQ ID NO: 59), *T atroviride* jgi-|Triat2|277859 (SEQ ID NO: 60), *Metarhizium acridum* gi|322695806 (SEQ ID NO: 61), *Fusarium oxysporum* gi|156071418 (SEQ ID NO: 62), *Cordyceps militaris* gi|346324830 (SEQ ID NO: 63), *Gibberella zeae* gi|46124247 (SEQ ID NO: 64), *Verticillium dahliae* gi|346978752 (SEQ ID NO: 65), *M. thermophila* gi367019798 (SEQ ID NO: 503), and homologs thereof.

Accordingly, in certain embodiments, a protease of the present disclosure, typically a pep5 protease, has an amino acid sequence having 50% or more identity (e.g. 60%, 65%, 70%, 75%, 80%, 85%, 90%, 91%, 92%, 93%, 94%, 95%, 96%, 97%, 98%, 99%, 99.5% or more to an amino acid sequence selected from SEQ ID NOs: 58-65, SEQ ID NO:503. In some embodiments, the protease has 100% identity to an amino acid sequence selected from SEQ ID NOs: 58-65, SEQ ID NO:503.

In some embodiments, pep5 is *T. reesei* pep5. The amino acid sequence encoded by *T. reesei* pep5 is set forth in SEQ ID NO: 58. In other embodiments, a protease of the present disclosure has an amino acid sequence having 50% or more identity (e.g. 60%, 65%, 70%, 75%, 80%, 85%, 90%, 91%, 92%, 93%, 94%, 95%, 96%, 97%, 98%, 99%, 99.5% or more) to SEQ ID NO: 58. In further embodiments, the protease has 100% identity to SEQ ID NO: 58.

Pep7

Examples of suitable pep7 genes include, without limitation, *Trichoderma reesei* pep7 (SEQ ID NO: 186), *Trichoderma atroviride* jgi|Triat2 (SEQ ID NO: 187), *Trichoderma virens* jgi|TriviGv29_8_2 (SEQ ID NO: 188), *Glomerella graminicola* gi|310800487 (SEQ ID NO: 189), *Metarhizium acridum* gi|322700577 (SEQ ID NO: 190), *Thielavia terrestris* gi|347003264 (SEQ ID NO: 191), *Podospora anserine* gi|171680938 (SEQ ID NO: 192), *Chaetomium thermophilum* gi|340905460 (SEQ ID NO: 193), *Verticillium dahliae* gi|346975960 (SEQ ID NO: 194), *Myceliophthora thermophila* gi|347009870, gi367026634 (SEQ ID NO: 195), *Neurospora crassa* gi|85090078 (SEQ ID NO: 196), *Magnaporthe oryzae* gi|39948622 (SEQ ID NO: 197), *Chaetomium globosum* gi|116191517 (SEQ ID NO: 198), *Magnaporthe oryzae* gi|39970765 (SEQ ID NO: 199), *A. nidulans* gi67522232 (SEQ ID NO: 504), *A. niger* gi350630464 (SEQ ID NO: 505), *A. oryzae* gi317138074 (SEQ ID NO: 506), and homologs thereof.

Accordingly, in certain embodiments, a protease of the present disclosure, typically a pep7 protease, has an amino acid sequence having 50% or more identity (e.g. 60%, 65%, 70%, 75%, 80%, 85%, 90%, 91%, 92%, 93%, 94%, 95%, 96%, 97%, 98%, 99%, 99.5% or more to an amino acid sequence selected from SEQ ID NOs: 186-199, SEQ ID NOs:504-506. In some embodiments, the protease has 100% identity to an amino acid sequence selected from SEQ ID NOs: 186-199, SEQ ID NOs:504-506.

In some embodiments, pep7 is *T. reesei* pep7. The amino acid sequence encoded by *T. reesei* pep7 is set forth in SEQ ID NO: 186. In other embodiments, a protease of the present disclosure has an amino acid sequence having 50% or more identity (e.g. 60%, 65%, 70%, 75%, 80%, 85%, 90%, 91%, 92%, 93%, 94%, 95%, 96%, 97%, 98%, 99%, 99.5% or more) to SEQ ID NO: 186. In further embodiments, the protease has 100% identity to SEQ ID NO: 186.

Pep8

Examples of suitable pep8 genes include, without limitation, *Trichoderma reesei* pep8 EGR48424 (SEQ ID NO: 507), *Trichoderma virens* EHK19238 (SEQ ID NO: 508), *Trichoderma atroviride* EHK40047 (SEQ ID NO: 509), *Neurospora tetrasperma* EGO53367 (SEQ ID NO: 510), *Myceliophthora thermophila* XP_003658897 (SEQ ID NO: 511), *Neurospora crassa* XP_965343 (SEQ ID NO: 512), *Metarhizium anisopliae* EFZ03501 (SEQ ID NO: 513), *Thielavia terrestris* XP_003656869 (SEQ ID NO: 514), *Fusarium oxysporum* EGU79769 (SEQ ID NO: 515), and *Gibberella zeae* XP_381566 (SEQ ID NO: 516), *Magnaporthe oryzae* XP_° ° 3714540.1 (SEQ ID NO:517), *P. chrysogenum* XP_002557331 (SEQ ID NO: 518), *A. oryzae* XP_001822899.1 (SEQ ID NO: 519), *A. nidulans* XP_664091.1 (SEQ ID NO: 520), *A. niger* EHA24387.1 (SEQ ID NO: 521), and homologs thereof.

Accordingly, in certain embodiments, a protease of the present disclosure, typically a pep8 protease, has an amino acid sequence having 50% or more identity (e.g. 60%, 65%, 70%, 75%, 80%, 85%, 90%, 91%, 92%, 93%, 94%, 95%, 96%, 97%, 98%, 99%, 99.5% or more to an amino acid sequence selected from SEQ ID NOs: 507-521. In some embodiments, the protease has 100% identity to an amino acid sequence selected from SEQ ID NOs: 507-521.

In some embodiments, pep8 is *T. reesei* pep8. The amino acid sequence encoded by *T. reesei* pep8 is set forth in SEQ ID NO: 507. In other embodiments, a protease of the present disclosure has an amino acid sequence having 50% or more identity (e.g. 60%, 65%, 70%, 75%, 80%, 85%, 90%, 91%, 92%, 93%, 94%, 95%, 96%, 97%, 98%, 99%, 99.5% or more) to SEQ ID NO: 507. In further embodiments, the protease has 100% identity to SEQ ID NO: 507.

Pep9

Examples of suitable pep9 genes include, without limitation, *Trichoderma reesei* pep9 79807 (SEQ ID NO: 750), *Trichoderma virens* 158334 (SEQ ID NO: 751), *Trichoderma atroviride* 90832 (SEQ ID NO: 752), *Fusarium graminicola* XP_384573.1 (SEQ ID NO: 753), *Neurospora crassa* XP_001727974.1 (SEQ ID NO: 754), *Myceliophthora thermophila* XP_003667167.1 (SEQ ID NO: 528), *Aspergillus oryzae* XP_001821372.2 (SEQ ID NO: 529), *Aspergillus niger* ABM05950.1 (SEQ ID NO: 755), *Aspergillus fumigatus* XP_752122.1 (SEQ ID NO: 756), *Aspergillus nidulans* XP_662026.1 (SEQ ID NO: 757), *Penicillium Wisconsin* XP_002565726.1 (SEQ ID NO: 758) and homologs thereof.

Accordingly, in certain embodiments, a protease of the present disclosure, typically a pep9 protease, has an amino acid sequence having 50% or more identity (e.g. 60%, 65%, 70%, 75%, 80%, 85%, 90%, 91%, 92%, 93%, 94%, 95%, 96%, 97%, 98%, 99%, 99.5% or more to an amino acid sequence selected from SEQ ID NOs: 750-758. In some embodiments, the protease has 100% identity to an amino acid sequence selected from SEQ ID NOs: 750-758.

In some embodiments, pep9 is *T. reesei* pep9. The amino acid sequence encoded by *T. reesei* pep9 is set forth in SEQ ID NO: 750. In other embodiments, a protease of the present disclosure has an amino acid sequence having 50% or more identity (e.g. 60%, 65%, 70%, 75%, 80%, 85%, 90%, 91%, 92%, 93%, 94%, 95%, 96%, 97%, 98%, 99%, 99.5% or more) to SEQ ID NO: 750. In further embodiments, the protease has 100% identity to SEQ ID NO: 750.

Pep11

Examples of suitable pep11 genes include, without limitation, *Trichoderma reesei* pep11 EGR49498 (SEQ ID NO: 522), *Trichoderma virens* EHK26120 (SEQ ID NO: 523), *Trichoderma atroviride* EHK41756 (SEQ ID NO: 524), *Fusarium pseudograminearum* EKJ74550 (SEQ ID NO: 525), *Metarhizium acridum* EFY91821 (SEQ ID NO: 526), and *Gibberella zeae* XP_384151 (SEQ ID NO: 527), *M. thermophila* XP_003667387.1 (SEQ ID NO: 528), *N. crassa* XP_960328.1 (SEQ ID NO: 529), and homologs thereof.

Accordingly, in certain embodiments, a protease of the present disclosure, typically a pep11 protease, has an amino acid sequence having 50% or more identity (e.g. 60%, 65%, 70%, 75%, 80%, 85%, 90%, 91%, 92%, 93%, 94%, 95%, 96%, 97%, 98%, 99%, 99.5% or more to an amino acid sequence selected from SEQ ID NOs: 522-529. In some embodiments, the protease has 100% identity to an amino acid sequence selected from SEQ ID NOs: 522-529.

In some embodiments, pep11 is *T. reesei* pep11. The amino acid sequence encoded by *T. reesei* pep11 is set forth in SEQ ID NO: 522. In other embodiments, a protease of the present disclosure has an amino acid sequence having 50% or more identity (e.g. 60%, 65%, 70%, 75%, 80%, 85%, 90%, 91%, 92%, 93%, 94%, 95%, 96%, 97%, 98%, 99%, 99.5% or more) to SEQ ID NO: 522. In further embodiments, the protease has 100% identity to SEQ ID NO: 522.

Pep12

Examples of suitable pep12 genes include, without limitation, *Trichoderma reesei* pep12 EGR52517 (SEQ ID NO: 530), *Trichoderma virens* pep12 EHK18859 (SEQ ID NO: 531), *Trichoderma atroviride* pep12 EHK45753 (SEQ ID NO: 532), *Fusarium pseudograminearum* pep12 EKJ73392 (SEQ ID NO: 533), *Gibberella zeae* pep12 XP_388759 (SEQ ID NO: 534), and *Metarhizium anisopliae* pep12 EFY95489 (SEQ ID NO: 535), *N. crassa* XP_964574.1 (SEQ ID NO: 536), *M. thermophila* XP_003659978.1 (SEQ ID NO: 537), and homologs thereof.

Accordingly, in certain embodiments, a protease of the present disclosure, typically a pep12 protease, has an amino acid sequence having 50% or more identity (e.g. 60%, 65%, 70%, 75%, 80%, 85%, 90%, 91%, 92%, 93%, 94%, 95%, 96%, 97%, 98%, 99%, 99.5% or more to an amino acid sequence selected from SEQ ID NOs: 530-537. In some embodiments, the protease has 100% identity to an amino acid sequence selected from SEQ ID NOs: 530-537.

In some embodiments, pep12 is *T. reesei* pep12. The amino acid sequence encoded by *T. reesei* pep12 is set forth in SEQ ID NO: 530. In other embodiments, a protease of the present disclosure has an amino acid sequence having 50% or more identity (e.g. 60%, 65%, 70%, 75%, 80%, 85%, 90%, 91%, 92%, 93%, 94%, 95%, 96%, 97%, 98%, 99%, 99.5% or more) to SEQ ID NO: 530. In further embodiments, the protease has 100% identity to SEQ ID NO: 530.

Pep6, pep10, pep13, pep14 and pep16

Other aspartic proteases include, without limitation, *T. reesei* pep6_(Tre68662, SEQ ID NO:880), pep10_(Tre78639, SEQ ID NO:881), pep13_(Tre76887, SEQ ID NO:882), pep14_(Tre108686, SEQ ID NO:883), or pep16_(Tre110490, SEQ ID NO:884), and homologs thereof.

Accordingly, in certain embodiments, a protease of the present disclosure, typically a pep6, pep10, pep13, pep14, pep16 protease, has an amino acid sequence having 50% or more identity (e.g. 60%, 65%, 70%, 75%, 80%, 85%, 90%, 91%, 92%, 93%, 94%, 95%, 96%, 97%, 98%, 99%, 99.5% or more to an amino acid sequence selected from SEQ ID NOs: 880-884. In some embodiments, the protease has 100% identity to an amino acid sequence selected from SEQ ID NOs: 880-884.

Trypsin-Like Serine Proteases

Trypsin-like serine proteases are enzymes with substrate specificity similar to that of trypsin. Trypsin-like serine proteases use a serine residue for hydrolysis of the peptide bonds in polypeptides and proteins. Typically, trypsin-like serine proteases cleave peptide bonds following a positively-charged amino acid residue. Trypsin-like serine proteases from eukaryotic organisms such as *Trichoderma* fungi include trypsin 1, trypsin 2, and mesotrypsin. Such trypsin-like serine proteases generally contain a catalytic triad of three amino acid residues (such as histidine, aspartate, and serine) that form a charge relay that serves to make the active site serine nucleophilic. Eukaryotic trypsin-like serine proteases further include an "oxyanion hole" formed by the backbone amide hydrogen atoms of glycine and serine, which can assist in identification of the polypeptides as being trypsin-like serine proteases.

One trypsin-like serine protease has been identified in *Trichoderma* fungal cells: tsp1 (tre73897). As discussed below, tsp1 has been demonstrated to have a significant impact on expression of recombinant polypeptides, such as immunoglobulins.

As discussed in Example 3 of WO 2013/102674, serine proteases were purified from *Trichoderma* and shown to have multiple protease activities that degrade mammalian proteins. Of these activities, tsp1 was identified as a trypsin-like serine protease. The tsp1 protease gene was then deleted from *Trichoderma* fungal cells and it was demonstrated that deleting tsp1 achieved a significant reduction in total protease activity resulting in increased stabilization of mammalian proteins produced by the cells.

Examples of suitable tsp1 proteases include, without limitation, *Trichoderma reesei* tsp1 (SEQ ID NO: 66), *Trichoderma atroviride* jgi|Triat2|298187 (SEQ ID NO: 67), jgi|TriviGv29_8_2 (SEQ ID NO: 68), *Hypocrea lixii* gi|145583579 (SEQ ID NO: 69), *Hypocrea lixii* gi|63025000 (SEQ ID NO: 70), *Sclerotinia sclerotiorum* gi|156052735 (SEQ ID NO: 71), *Botryotinia fuckeliana* gi|154314937 (SEQ ID NO: 72), *Phaeosphaeria nodorum* gi|169605891 (SEQ ID NO: 73), *Leptosphaeria maculans* gi|312219044 (SEQ ID NO: 74), *Verticillium dahliae* gi|37992773 (SEQ ID NO: 75), *Cochliobolus carbonum* gi|1072114 (SEQ ID NO: 76), *Metarhizium acridum* gi|322695345 (SEQ ID NO: 77), *Metarhizium anisopliae* gi|4768909 (SEQ ID NO: 78), gi|464963 (SEQ ID NO: 79), *Gibberella zeae* gi|46139299 (SEQ ID NO: 80), *Metarhizium anisopliae* (SEQ ID NO: 81), *A. nidulans* gi67523821 (SEQ ID NO: 538) and homologs thereof.

Accordingly, in certain embodiments, a protease of the present disclosure, typically tsp1 protease, has an amino acid sequence having 50% or more identity (e.g. 60%, 65%, 70%, 75%, 80%, 85%, 90%, 91%, 92%, 93%, 94%, 95%, 96%, 97%, 98%, 99%, 99.5% or more to an amino acid sequence selected from SEQ ID NOs: 66-81, SEQ ID NO:538. In some embodiments, the protease has 100% identity to an amino acid sequence selected from SEQ ID NOs: 66-81, SEQ ID NO:538.

In some embodiments, tsp1 is *T. reesei* tsp1. The amino acid sequence encoded by *T. reesei* tsp1 is set forth in SEQ ID NO: 66. In other embodiments, a protease of the present disclosure has an amino acid sequence having 50% or more identity (e.g. 60%, 65%, 70%, 75%, 80%, 85%, 90%, 91%, 92%, 93%, 94%, 95%, 96%, 97%, 98%, 99%, 99.5% or more) to SEQ ID NO: 66. In further embodiments, the protease has 100% identity to SEQ ID NO: 66.

Subtilisin Proteases

Subtilisin proteases are enzymes with substrate specificity similar to that of subtilisin. Subtilisin proteases use a serine residue for hydrolysis of the peptide bonds in polypeptides and proteins. Generally, subtilisin proteases are serine proteases that contain a catalytic triad of the three amino acids aspartate, histidine, and serine. The arrangement of these catalytic residues is shared with the prototypical subtilisin from *Bacillus licheniformis*. Subtilisin proteases from eukaryotic organisms such as *Trichoderma* fungi include furin, MBTPS1, and TPP2. Eukaryotic trypsin-like serine proteases further include an aspartic acid residue in the oxyanion hole. Subtilisin protease slp7 resembles also sedolisin protease tpp1.

Seven subtilisin proteases have been identified in *Trichoderma* fungal cells: slp1 (tre51365); slp2 (tre123244); slp3 (tre123234); slp5 (tre64719), slp6 (tre121495), slp7 (tre123865), and slp8 (tre58698).

Slp1

Examples of suitable slp1 proteases include, without limitation, *Trichoderma reesei* slp1 (SEQ ID NO: 82), *Trichoderma atroviride* jgi|Triat2 (SEQ ID NO: 83), *Trichoderma atroviride* jgi|Triat2 (SEQ ID NO: 84), *Trichoderma virens* jgi|TriviGv29_8_2 (SEQ ID NO: 85), *Hypocrea lixii* gi|145583581 (SEQ ID NO: 86), *Metarhizium acridum* gi|322694632 (SEQ ID NO: 87), *Fusarium oxysporum* gi|342877080 (SEQ ID NO: 88), *Gibberella zeae* gi|46139915 (SEQ ID NO: 89), *Epichloe festucae* gi|170674476 (SEQ ID NO: 90), *Nectria haematococca* gi|302893164 (SEQ ID NO: 91), *Sordaria macrospore* gi|336266150 (SEQ ID NO: 92), *Glomerella graminicola* gi|310797947 (SEQ ID NO: 93), *Neurospora tetrasperma* gi|336469805 (SEQ ID NO: 94), *Neurospora crassa* gi|85086707 (SEQ ID NO: 95), *Magnaporthe oryzae* gi|145608997 (SEQ ID NO: 96), *Chaetomium globosum* gi|116208730 (SEQ ID NO: 97), *M. thermophila* gi367029081 (SEQ ID NO: 539), and homologs thereof.

Accordingly, in certain embodiments, a protease of the present disclosure, typically a slp1 protease, has an amino acid sequence having 50% or more identity (e.g. 60%, 65%, 70%, 75%, 80%, 85%, 90%, 91%, 92%, 93%, 94%, 95%, 96%, 97%, 98%, 99%, 99.5% or more to an amino acid sequence selected from SEQ ID NOs: 82-97, SEQ ID NO:539. In some embodiments, the protease has 100% identity to an amino acid sequence selected from SEQ ID NOs: 82-97, SEQ ID NO:539.

In some embodiments, slp1 is *T. reesei* slp1. The amino acid sequence encoded by *T. reesei* slp1 is set forth in SEQ ID NO: 82. In other embodiments, a protease of the present disclosure has an amino acid sequence having 50% or more identity (e.g. 60%, 65%, 70%, 75%, 80%, 85%, 90%, 91%, 92%, 93%, 94%, 95%, 96%, 97%, 98%, 99%, 99.5% or more) to SEQ ID NO: 82. In further embodiments, the protease has 100% identity to SEQ ID NO: 82.

Slp2

Examples of suitable slp2 proteases include, without limitation, *Trichoderma reesei* slp2 (SEQ ID NO: 98), *T atroviride* jgi|Triat2 (SEQ ID NO: 99), *T virens* jgi|TriviGv29_8_2 (SEQ ID NO: 100), *Hypocrea lixii* gi|115111226 (SEQ ID NO: 101), *Aspergillus fumigatus* gi|70997972 (SEQ ID NO: 102), *Nectria haematococca* gi|302915240 (SEQ ID NO: 103), *Gibberella zeae* gi|46105128 (SEQ ID NO: 104), *Isaria farinose* gi|68165000 (SEQ ID NO: 105), *Glomerella graminicola* gi|310797854 (SEQ ID NO: 106), *Epichloe festucae* gi|170674491 (SEQ ID NO: 107), *Metarhizium acridum* gi|322697754 (SEQ ID NO: 108), *Acremonium* sp. F11177 gi|147225254 (SEQ ID NO: 109), *Ophiostoma piliferum* gi|15808807 (SEQ ID NO: 110), *Neurospora tetrasperma* gi|336463649 (SEQ ID NO: 111), *Chaetomium thermophilum* gi|340992600 (SEQ ID NO: 112), *Metarhizium flavoviride* gi|254351265 (SEQ ID NO: 113), *Podospora anserine* gi|171680111 (SEQ ID NO: 114), *Magnaporthe oryzae* gi|39943180 (SEQ ID NO: 115), *Sclerotinia sclerotiorum* gi|156058540 (SEQ ID NO: 116), *Talaromyces stipitatus* gi|242790441 (SEQ ID NO: 117), *M. thermophila* gi367021472 (SEQ ID NO: 540), *A. niger* gi|45237646 (SEQ ID NO: 541), *A. oryzae* gi|69780712 (SEQ ID NO: 542), *P. chrysogenum* gi255955889 (SEQ ID NO: 543), *A. nidulans* gi259489544 (SEQ ID NO: 544), *N. crassa* gi85084841 (SEQ ID NO: 545), and homologs thereof.

Accordingly, in certain embodiments, a protease of the present disclosure, typically a slp2 protease, has an amino acid sequence having 50% or more identity (e.g. 60%, 65%, 70%, 75%, 80%, 85%, 90%, 91%, 92%, 93%, 94%, 95%, 96%, 97%, 98%, 99%, 99.5% or more to an amino acid sequence selected from SEQ ID NOs: 98-117, SEQ ID NOs:540-545. In some embodiments, the protease has 100% identity to an amino acid sequence selected from SEQ ID NOs: 98-117, SEQ ID NOs:540-545.

In some embodiments, slp2 is *T. reesei* slp2. The amino acid sequence encoded by *T. reesei* slp2 is set forth in SEQ ID NO: 98. In other embodiments, a protease of the present disclosure has an amino acid sequence having 50% or more identity (e.g. 60%, 65%, 70%, 75%, 80%, 85%, 90%, 91%, 92%, 93%, 94%, 95%, 96%, 97%, 98%, 99%, 99.5% or more) to SEQ ID NO: 98. In further embodiments, the protease has 100% identity to SEQ ID NO: 98.

Slp3

Examples of suitable slp3 proteases include, without limitation, *Trichoderma reesei* slp2 (SEQ ID NO: 166), *T. atroviride* jgi|Triat2 (SEQ ID NO: 167), *T. virens* jgi|TriviGv29_8_2 (SEQ ID NO: 168), *Hypocrea koningii* gi|124295071 (SEQ ID NO: 169), *Purpureocillium lilacinum* gi|130750164 (SEQ ID NO: 170), *Metarhizium anisopliae* gi|16215677 (SEQ ID NO: 171), *Hirsutella rhossiliensis* gi|90655148 (SEQ ID NO: 172), *Tolypocladium inflatum* gi|18542429 (SEQ ID NO: 173), *Metacordyceps chlamydosporia* gi|19171215 (SEQ ID NO: 174), *Cordyceps militaris* gi|346321368 (SEQ ID NO: 175), *Fusarium* sp. gi|628051 (SEQ ID NO: 176), *Neurospora tetrasperma* gi|336471881 (SEQ ID NO: 177), *Chaetomium globosum* gi|116197403 (SEQ ID NO: 178), *Neurospora crassa* gi|85084841 (SEQ ID NO: 179), *Fusarium oxysporum* gi|56201265 (SEQ ID NO: 180), *Gibberella zeae* gi|46114268 (SEQ ID NO: 181), *M. thermophila* gi367026259 (SEQ ID NO: 546), *A. nidulans* gi67538776 (SEQ ID NO: 547), *A. oryzae* gi|69771349 (SEQ ID NO: 222), *A. niger* gi470729 (SEQ ID NO: 223), and homologs thereof.

Accordingly, in certain embodiments, a protease of the present disclosure, typically a slp3 protease, has an amino acid sequence having 50% or more identity (e.g. 60%, 65%, 70%, 75%, 80%, 85%, 90%, 91%, 92%, 93%, 94%, 95%, 96%, 97%, 98%, 99%, 99.5% or more to an amino acid sequence selected from SEQ ID NOs: 166-181, SEQ ID NOs:546-547, SEQ ID NOs:222-223. In some embodiments, the protease has 100% identity to an amino acid sequence selected from SEQ ID NOs: 166-181, SEQ ID NOs:546-547, SEQ ID NOs:222-223.

In some embodiments, slp3 is *T. reesei* slp3. The amino acid sequence encoded by *T. reesei* slp3 is set forth in SEQ ID NO: 166. In other embodiments, a protease of the present disclosure has an amino acid sequence having 50% or more identity (e.g. 60%, 65%, 70%, 75%, 80%, 85%, 90%, 91%, 92%, 93%, 94%, 95%, 96%, 97%, 98%, 99%, 99.5% or more) to SEQ ID NO: 166. In further embodiments, the protease has 100% identity to SEQ ID NO: 166.

Slp5

Examples of suitable slp5 proteases include, without limitation, *Trichoderma reesei* slp5 (SEQ ID NO: 200), *T. atroviride* jgi|Triat2 (SEQ ID NO: 201), *T. virens* jgi|TriviGv29_8_2 (SEQ ID NO: 202), *Hypocrea lixii* gi|118161442 (SEQ ID NO: 203), *Fusarium oxysporum* gi|342883549 (SEQ ID NO: 204), *Gibberella zeae* gi|46135733 (SEQ ID NO: 205), *Glomerella graminicola* gi|310796396 (SEQ ID NO: 206), *Nectria haematococca* gi|302927954 (SEQ ID NO: 207), *Cordyceps militaris* gi|346319783 (SEQ ID NO: 208), *Neurospora crassa* gi|85094084 (SEQ ID NO: 209), *Neurospora tetrasperma* gi|336467281 (SEQ ID NO: 210), *Verticillium dahliae* gi|346971706 (SEQ ID NO: 211), *Thielavia terrestris* gi|347001418 (SEQ ID NO: 212), *Magnaporthe oryzae* gi|145605493 (SEQ ID NO: 213), *M. thermophila* gi367032200 (SEQ ID NO: 548), *P. chrysogenum* gi62816282 (SEQ ID NO: 549), and homologs thereof.

Accordingly, in certain embodiments, a protease of the present disclosure, typically a slp5 protease, has an amino acid sequence having 50% or more identity (e.g. 60%, 65%, 70%, 75%, 80%, 85%, 90%, 91%, 92%, 93%, 94%, 95%, 96%, 97%, 98%, 99%, 99.5% or more to an amino acid sequence selected from SEQ ID NOs: 200-213, SEQ ID NOs:548-549. In some embodiments, the protease has 100% identity to an amino acid sequence selected from SEQ ID NOs: 200-213, SEQ ID NOs:548-549.

In some embodiments, slp5 is *T. reesei* slp5. The amino acid sequence encoded by *T. reesei* slp5 is set forth in SEQ ID NO: 200. In other embodiments, a protease of the present disclosure has an amino acid sequence having 50% or more identity (e.g. 60%, 65%, 70%, 75%, 80%, 85%, 90%, 91%, 92%, 93%, 94%, 95%, 96%, 97%, 98%, 99%, 99.5% or more) to SEQ ID NO: 200. In further embodiments, the protease has 100% identity to SEQ ID NO: 200.

Slp6

Examples of suitable slp6 proteases include, without limitation, *Trichoderma reesei* slp6 (SEQ ID NO: 214), *T. atroviride* jgi|Triat2 (SEQ ID NO: 215), *T. virens* jgi|TriviGv29_8_2 (SEQ ID NO: 216), *Hypocrea virens* gi|29421423 (SEQ ID NO: 217), *Hypocrea lixii* gi|145583127 (SEQ ID NO: 218), *Trichoderma hamatum* gi|30144643 (SEQ ID NO: 219), *Aspergillus fumigatus* gi|2295 (SEQ ID NO: 220), *Aspergillus terreus* gi|115391147 (SEQ ID NO: 221), *Aspergillus oryzae* gi|169771349 (SEQ ID NO: 222), *Aspergillus niger* gi|470729 (SEQ ID NO: 223), *Glomerella graminicola* gi|310794714 (SEQ ID NO: 224), *Gibberella zeae* gi|46114946 (SEQ ID NO: 225), *Fusarium oxysporum* gi|342873942 (SEQ ID NO: 226), *Nectria haematococca* gi|302884541 (SEQ ID NO: 227), *Neosartorya fischeri* gi|119500190 (SEQ ID NO: 228), *Verticillium alboatrum* gi|302413161 (SEQ ID NO: 229), *Glomerella graminicola* gi|310790144 (SEQ ID NO: 230), *N. crassa* gi85090020 (SEQ ID NO: 550), and homologs thereof.

Accordingly, in certain embodiments, a protease of the present disclosure, typically a slp6 protease, has an amino acid sequence having 50% or more identity (e.g. 60%, 65%, 70%, 75%, 80%, 85%, 90%, 91%, 92%, 93%, 94%, 95%, 96%, 97%, 98%, 99%, 99.5% or more to an amino acid sequence selected from SEQ ID NOs: 214-230, SEQ ID NO:550. In some embodiments, the protease has 100% identity to an amino acid sequence selected from SEQ ID NOs: 214-230, SEQ ID NO:550.

In some embodiments, slp6 is *T. reesei* slp6. The amino acid sequence encoded by *T. reesei* slp6 is set forth in SEQ ID NO: 214. In other embodiments, a protease of the present disclosure has an amino acid sequence having 50% or more identity (e.g. 60%, 65%, 70%, 75%, 80%, 85%, 90%, 91%, 92%, 93%, 94%, 95%, 96%, 97%, 98%, 99%, 99.5% or more) to SEQ ID NO: 214. In further embodiments, the protease has 100% identity to SEQ ID NO: 214.

Slp7

Examples of suitable slp7 proteases include, without limitation, *Trichoderma reesei* slp7 (SEQ ID NO: 231), *T. atroviride* jgi|Triat2 (SEQ ID NO: 232), *T. virens* jgi|TriviGv29_8_2 (SEQ ID NO: 233), *Metarhizium anisopliae* gi|322710320 (SEQ ID NO: 234), *Nectria haematococca* gi|302915000 (SEQ ID NO: 235), *Myceliophthora thermophila* gi|347009020, gi|367024935 (SEQ ID NO: 236), *Gibberella zeae* gi|46137655 (SEQ ID NO: 237), *Thielavia terrestris* gi|346996549 (SEQ ID NO: 238), *Magnaporthe oryzae* gi|145610733 (SEQ ID NO: 239), *A. nidulans* gi67541991 (SEQ ID NO: 551), *P. chrysogenum* gi255933786 (SEQ ID NO: 552), *A. niger* gi317036543

(SEQ ID NO: 553), *A. oryzae* gi|69782882 (SEQ ID NO: 554), *N. crassa* gi85109979 (SEQ ID NO: 555), and homologs thereof.

Accordingly, in certain embodiments, a protease of the present disclosure, typically a slp7 protease, has an amino acid sequence having 50% or more identity (e.g. 60%, 65%, 70%, 75%, 80%, 85%, 90%, 91%, 92%, 93%, 94%, 95%, 96%, 97%, 98%, 99%, 99.5% or more to an amino acid sequence selected from SEQ ID NOs: 231-239, SEQ ID NOs:551-555. In some embodiments, the protease has 100% identity to an amino acid sequence selected from SEQ ID NOs: 231-239, SEQ ID NOs:551-555.

In some embodiments, slp7 is *T. reesei* slp7. The amino acid sequence encoded by *T. reesei* slp7 is set forth in SEQ ID NO: 231. In other embodiments, a protease of the present disclosure has an amino acid sequence having 50% or more identity (e.g. 60%, 65%, 70%, 75%, 80%, 85%, 90%, 91%, 92%, 93%, 94%, 95%, 96%, 97%, 98%, 99%, 99.5% or more) to SEQ ID NO: 231. In further embodiments, the protease has 100% identity to SEQ ID NO: 231.

Slp8

Examples of suitable slp8 proteases include, without limitation, *Trichoderma reesei* slp8 (SEQ ID NO: 240), *T. atroviride* jgi|Triat2|198568 (SEQ ID NO: 241), *T. virens* jgi|TriviGv29_8_2β3902 (SEQ ID NO: 242), and homologs thereof.

Accordingly, in certain embodiments, a protease of the present disclosure has an amino acid sequence having 50% or more identity (e.g. 60%, 65%, 70%, 75%, 80%, 85%, 90%, 91%, 92%, 93%, 94%, 95%, 96%, 97%, 98%, 99%, 99.5% or more to an amino acid sequence selected from SEQ ID NOs: 240-242. In some embodiments, the protease has 100% identity to an amino acid sequence selected from SEQ ID NOs: 240-242.

In some embodiments, slp8 is *T. reesei* slp8. The amino acid sequence encoded by *T. reesei* slp8 is set forth in SEQ ID NO: 240. In other embodiments, a protease of the present disclosure has an amino acid sequence having 50% or more identity (e.g. 60%, 65%, 70%, 75%, 80%, 85%, 90%, 91%, 92%, 93%, 94%, 95%, 96%, 97%, 98%, 99%, 99.5% or more) to SEQ ID NO: 240. In further embodiments, the protease has 100% identity to SEQ ID NO: 240.

Slp Like Proteases

Other slp-like proteases include, without limitation, slp57433 (Tre57433 SEQ ID NO:885), slp35726_(Tre35726 SEQ ID NO:886), slp60791_(Tre60791 SEQ ID NO:887) or slp109276_(Tre109276 SEQ ID NO:888), and homologs thereof.

Accordingly, in certain embodiments, a protease of the present disclosure, typically a slp57433, slp35726, slp60791 or slp109276 protease, has an amino acid sequence having 50% or more identity (e.g. 60%, 65%, 70%, 75%, 80%, 85%, 90%, 91%, 92%, 93%, 94%, 95%, 96%, 97%, 98%, 99%, 99.5% or more to an amino acid sequence selected from SEQ ID NOs: 885-888. In some embodiments, the protease has 100% identity to an amino acid sequence selected from SEQ ID NOs: 885-888.

Glutamic Proteases

Glutamic proteases are enzymes that hydrolyze the peptide bonds in polypeptides and proteins. Glutamic proteases are insensitive to pepstatin A, and so are sometimes referred to as pepstatin insensitive acid proteases. While glutamic proteases were previously grouped with the aspartic proteases and often jointly referred to as acid proteases, it has been recently found that glutamic proteases have very different active site residues than aspartic proteases.

Two glutamic proteases have been identified in *Trichoderma* fungal cells: gap1 (tre69555) and gap2 (tre106661).

Gap1

Examples of suitable gap1 proteases include, without limitation, *Trichoderma reesei* gap1 (SEQ ID NO: 118), *T. atroviride* jgi|Triat2|40863 (SEQ ID NO: 119), *T. virens* jgi|TriviGv29_8_2|192684 (SEQ ID NO: 120), *Aspergillus flavus* gi|238499183 (SEQ ID NO: 121), *Aspergillus niger* gi|145251555 (SEQ ID NO: 122), *Aspergillus terreus* gi|115491521 (SEQ ID NO: 123), gi|37154543 (SEQ ID NO: 124), gi|48425531 (SEQ ID NO: 125), gi|351873 (SEQ ID NO: 126), *Thielavia terrestris* gi|346997245 (SEQ ID NO: 127), *Penicillium chrysogenum* gi|255940586 (SEQ ID NO: 128), *M. thermophila* gi367026504 (SEQ ID NO: 574), *A. oryzae* gi317150886 (SEQ ID NO: 575), *N. crassa* gi85097968 (SEQ ID NO: 576), *A. niger* gi131056 (SEQ ID NO: 577), *P. chrysogenum* gi255930123 (SEQ ID NO: 578), *A. niger* gi145236956 (SEQ ID NO: 579), *A. oryzae* gi169772955 (SEQ ID NO: 580), *A. niger* gi145249222 (SEQ ID NO: 581), *A. nidulans* gi67525839 (SEQ ID NO: 582), *A. oryzae* gi169785367 (SEQ ID NO: 583), *P. chrysogenum* gi255955319 (SEQ ID NO: 584), *M. thermophila* gi367019352 (SEQ ID NO: 585), *A oryzae* gi391863974 (SEQ ID NO: 586), *M. thermophila* gi367024513 (SEQ ID NO: 587), and homologs thereof.

Accordingly, in certain embodiments, a protease of the present disclosure, typically a gap1 protease, has an amino acid sequence having 50% or more identity (e.g. 60%, 65%, 70%, 75%, 80%, 85%, 90%, 91%, 92%, 93%, 94%, 95%, 96%, 97%, 98%, 99%, 99.5% or more to an amino acid sequence selected from SEQ ID NOs: 118-128, SEQ ID NOs:574-587. In some embodiments, the protease has 100% identity to an amino acid sequence selected from SEQ ID NOs: 118-128, SEQ ID NOs:574-587.

In some embodiments, gap1 is *T. reesei* gap1. The amino acid sequence encoded by *T. reesei* gap1 is set forth in SEQ ID NO: 118. In other embodiments, a protease of the present disclosure has an amino acid sequence having 50% or more identity (e.g. 60%, 65%, 70%, 75%, 80%, 85%, 90%, 91%, 92%, 93%, 94%, 95%, 96%, 97%, 98%, 99%, 99.5% or more) to SEQ ID NO: 118. In further embodiments, the protease has 100% identity to SEQ ID NO: 118.

Gap2

Examples of suitable gap2 proteases include, without limitation, *Trichoderma reesei* gap2 (SEQ ID NO: 129), *T. atroviride* jgi|Triat2|298116 (SEQ ID NO: 130), *T. virens* jgi|TriviGv29_8_2|30331 (SEQ ID NO: 131), jgi|TriviGv29_8_2|225131 (SEQ ID NO: 132), *Aspergillus flavus* gi|238499183 (SEQ ID NO: 133), *Aspergillus niger* gi|145251555 (SEQ ID NO: 134), *Aspergillus nidulans* gi|67901056 (SEQ ID NO: 135), *Aspergillus clavatus* gi|121711990 (SEQ ID NO: 136), *Aspergillus fumigatus* gi|70986250 (SEQ ID NO: 137), *Penicillium marneffei* gi|212534108 (SEQ ID NO: 138), *Talaromyces stipitatus* gi|242789335 (SEQ ID NO: 139), *Grosmannia clavigera* gi|320591529 (SEQ ID NO: 140), *Neosartorya fischeri* gi|119474281 (SEQ ID NO: 141), *Penicillium marneffei* gi|212527274 (SEQ ID NO: 142), *Penicillium chrysogenum* gi|255940586 (SEQ ID NO: 143), gi|131056 (SEQ ID NO: 144), *M. thermophila* gi367030275 (SEQ ID NO: 588), and homologs thereof.

Accordingly, in certain embodiments, a protease of the present disclosure, typically a gap2 protease, has an amino acid sequence having 50% or more identity (e.g. 60%, 65%, 70%, 75%, 80%, 85%, 90%, 91%, 92%, 93%, 94%, 95%, 96%, 97%, 98%, 99%, 99.5% or more to an amino acid sequence selected from SEQ ID NOs: 129-144, SEQ ID NO:588. In some embodiments, the protease has 100% identity to an amino acid sequence selected from SEQ ID NOs: 129-144, SEQ ID NO:588.

In some embodiments, gap2 is *T. reesei* gap2. The amino acid sequence encoded by *T. reesei* gap2 is set forth in SEQ ID NO: 129. In other embodiments, a protease of the present disclosure has an amino acid sequence having 50% or more identity (e.g. 60%, 65%, 70%, 75%, 80%, 85%, 90%, 91%, 92%, 93%, 94%, 95%, 96%, 97%, 98%, 99%, 99.5% or more) to SEQ ID NO: 129. In further embodiments, the protease has 100% identity to SEQ ID NO: 129.

Other gap-like proteases include, without limitation, gap3 (Tre70927 SEQ ID NO:889), or gap4_(Tre57575 SEQ ID NO:890), and homologs thereof.

Accordingly, in certain embodiments, a protease of the present disclosure, typically a gap3 or gap4 protease, has an amino acid sequence having 50% or more identity (e.g. 60%, 65%, 70%, 75%, 80%, 85%, 90%, 91%, 92%, 93%, 94%, 95%, 96%, 97%, 98%, 99%, 99.5% or more to an amino acid sequence selected from SEQ ID NO:889 or SEQ ID NO:890 respectively. In some embodiments, the protease has 100% identity to an amino acid sequence selected from SEQ ID NOs: 889-889.

Sedolisin Proteases

Sedolisin proteases are enzymes that use a serine residue for hydrolysis of the peptide bonds in polypeptides and proteins. Sedolisin proteases generally contain a unique catalytic triad of serine, glutamate, and aspartate. Sedolisin proteases also contain an aspartate residue in the oxyanion hole. Sedolisin proteases from eukaryotic organisms such as *Trichoderma* fungi include tripeptidyl peptidase.

Examples of suitable tpp1 proteases include, without limitation, *Trichoderma reesei* tpp1 (SEQ ID NO: 145), *T. atroviride* jgi|Triat2|188756 (SEQ ID NO: 146), *T. virens* jgi|TriviGv29_8_2|217176 (SEQ ID NO: 147), *Aspergillus fumigatus* gi|70993168 (SEQ ID NO: 148), *Aspergillus oryzae* gi|169776800 (SEQ ID NO: 149), *Aspergillus niger* gi|145236399 (SEQ ID NO: 150), *Aspergillus clavatus* gi|121708799 (SEQ ID NO: 151), *Aspergillus niger* gi|145239871 (SEQ ID NO: 152), *Aspergillus clavatus* gi|121714541 (SEQ ID NO: 153), *Aspergillus terreus* gi|115387645 (SEQ ID NO: 154), *Aspergillus fumigatus* gi|70982015 (SEQ ID NO: 155), *Sclerotinia sclerotiorum* gi|156045898 (SEQ ID NO: 156), *Botryotinia fuckeliana* gi|154321758 (SEQ ID NO: 157), *Neosartorya fischeri* gi|119499774 (SEQ ID NO: 158), *Talaromyces stipitatus* gi|242798348 (SEQ ID NO: 159), *Penicillium marneffei* gi|212541546 (SEQ ID NO: 160), *Gibberella zeae* gi|46114460 (SEQ ID NO: 161), *Fusarium oxysporum* gi|342890694 (SEQ ID NO: 162), *Grosmannia clavigera* gi|320592937 (SEQ ID NO: 163), *Verticillium alboatrum* gi|302406186 (SEQ ID NO: 164), *Verticillium dahliae* gi|346971444 (SEQ ID NO: 165), *A. fumigatus* CAE51075.1 (SEQ ID NO: 556), *A. oryzae* XP_001820835.1 (SEQ ID NO: 557), *P. chrysogenum* XP_002564029.1 (SEQ ID NO: 558), *A. nidulans* XP_664805.1 (SEQ ID NO: 559), *P. chrysogenum* XP_002565814.1 (SEQ ID NO: 560), *M. thermophila* XP_003663689.1 (SEQ ID NO: 561), *N. crassa* XP_958412.1 (SEQ ID NO: 562), *A. niger* XP_001394118.1 (SEQ ID NO: 563), *A. fumigatus* CAE17674.1 (SEQ ID NO: 564), *A. niger* XP_001400873.1 (SEQ ID NO: 565), *A. fumigatus* CAE46473.1 (SEQ ID NO: 566), *A. oryzae* XP_002373530.1 (SEQ ID NO: 567), *A. nidulans* XP_660624.1 (SEQ ID NO: 568), *P. chrysogenum* XP_002562943.1 (SEQ ID NO: 569), *A. fumigatus* CAE17675.1 (SEQ ID NO: 570), *A. fumigatus* EAL86850.2 (SEQ ID NO: 571), *N. crassa* XP_961957.1 (SEQ ID NO: 572), *A. oryzae* BAB97387.1 (SEQ ID NO: 573), and homologs thereof.

Accordingly, in certain embodiments, a protease of the present disclosure, typically a tpp1 protease, has an amino acid sequence having 50% or more identity (e.g. 60%, 65%, 70%, 75%, 80%, 85%, 90%, 91%, 92%, 93%, 94%, 95%, 96%, 97%, 98%, 99%, 99.5% or more to an amino acid sequence selected from SEQ ID NOs: 145-165, SEQ ID NOs:556-573. In some embodiments, the protease has 100% identity to an amino acid sequence selected from SEQ ID NOs: 145-165, SEQ ID NOs:556-573.

In some embodiments, tpp1 is *T. reesei* tpp1. The amino acid sequence encoded by *T. reesei* tpp1 is set forth in SEQ ID NO: 145. In other embodiments, a protease of the present disclosure has an amino acid sequence having 50% or more identity (e.g. 60%, 65%, 70%, 75%, 80%, 85%, 90%, 91%, 92%, 93%, 94%, 95%, 96%, 97%, 98%, 99%, 99.5% or more) to SEQ ID NO: 145. In further embodiments, the protease has 100% identity to SEQ ID NO: 145.

Other sedolisin-like proteases include, without limitation, sed2 (Tre70962, SEQ ID NO:891), sed3_(Tre81517 SEQ ID NO:892), or sed5_(Tre111838 SEQ ID NO:893), and homologs thereof.

Accordingly, in certain embodiments, a protease of the present disclosure, typically a sed2, sed3 or sed5 protease, has an amino acid sequence having 50% or more identity (e.g. 60%, 65%, 70%, 75%, 80%, 85%, 90%, 91%, 92%, 93%, 94%, 95%, 96%, 97%, 98%, 99%, 99.5% or more to an amino acid sequence selected from SEQ ID NOs: 891-893. In some embodiments, the protease has 100% identity to an amino acid sequence selected from SEQ ID NOs: 891-893.

Aminopeptidase Proteases

Aminopeptidases catalyze the cleavage of amino acids from the amino terminus of protein or peptide substrates. They are widely distributed throughout the animal and plant kingdoms and are found in many subcellular organelles, in cytoplasm, and as membrane components. Many, but not all, of these peptidases are zinc metalloenzymes. Amp2 is a bifunctional enzyme. It is a leukotriene A4 hydrolase with aminopeptidase activity (EC 3.3.2.6).

Two aminopeptidases have been identified in *Trichoderma* fungal cells: amp1 (tre81070) and amp2 (tre108592).

Amp1

Examples of suitable amp1 proteases include, without limitation, *Trichoderma reesei* amp1 81070 (SEQ ID NO: 759), *T. virens* 74747 (SEQ ID NO: 760), *T. atroviride* 147450 (SEQ ID NO: 761), *F. graminicola* XP_386703.1 (SEQ ID NO: 762), *A. nidulans* CBF75094.1 (SEQ ID NO: 763), *A. niger* EHA21022.1 (SEQ ID NO: 764), *A. oryzae* XP_001727175.1 (SEQ ID NO: 765), *A. fumigatus* XP_749158.1 (SEQ ID NO: 766), *M. thermophila* XP_003667354.1 (SEQ ID NO: 767), *F. graminicola* XP_385112.1 (SEQ ID NO: 768), *P. Chrysogenum* XP_002567159.1 (SEQ ID NO: 769), *A. fumigatus* XP_748386.2 (SEQ ID NO: 770), *A. oryzae* XP_001819545.1 (SEQ ID NO: 771), *A. nidulans* XP_681714.1 (SEQ ID NO: 772), *N. crassa* XP_957507.1 (SEQ ID NO: 773), *M. thermo* XP_003665703.1 (SEQ ID NO: 774), and homologs thereof.

Accordingly, in certain embodiments, a protease of the present disclosure, typically a amp1 protease, has an amino acid sequence having 50% or more identity (e.g. 60%, 65%, 70%, 75%, 80%, 85%, 90%, 91%, 92%, 93%, 94%, 95%, 96%, 97%, 98%, 99%, 99.5% or more to an amino acid sequence selected from SEQ ID NOs: 759-774. In some embodiments, the protease has 100% identity to an amino acid sequence selected from SEQ ID NOs: 759-774.

In some embodiments, amp1 is *T. reesei* amp1. The amino acid sequence encoded by *T. reesei* amp1 is set forth in SEQ ID NO: 759. In other embodiments, a protease of the present disclosure has an amino acid sequence having 50% or more identity (e.g. 60%, 65%, 70%, 75%, 80%, 85%, 90%, 91%, 92%, 93%, 94%, 95%, 96%, 97%, 98%, 99%, 99.5% or more) to SEQ ID NO: 759. In further embodiments, the protease has 100% identity to SEQ ID NO: 759.

Amp2

Examples of suitable amp2 proteases include, without limitation, *Trichoderma reesei* amp2 108592 (SEQ ID NO: 775), *T. virens* 73611 (SEQ ID NO: 776), *T. atroviride* 284076 (SEQ ID NO: 777), *F. graminicola* XP_390364.1 (SEQ ID NO: 778), *N. crassa* XP_960660.1 (SEQ ID NO: 779), *M. thermophila* XP_003662184.1 (SEQ ID NO: 780), *A. oryzae* XP_001826499.2 (SEQ ID NO: 781), *A. niger* XP_001390581.1 (SEQ ID NO: 782), *A. nidulans* XP_663416.1 (SEQ ID NO: 783), *A. fumigatus* XP_755088.1 (SEQ ID NO: 784), *P. chrysogenum* XP_002558974.1 (SEQ ID NO: 785) and homologs thereof.

Accordingly, in certain embodiments, a protease of the present disclosure, typically a amp2 protease, has an amino acid sequence having 50% or more identity (e.g. 60%, 65%, 70%, 75%, 80%, 85%, 90%, 91%, 92%, 93%, 94%, 95%, 96%, 97%, 98%, 99%, 99.5% or more to an amino acid sequence selected from SEQ ID NOs: 775-785. In some embodiments, the protease has 100% identity to an amino acid sequence selected from SEQ ID NOs: 775-785.

In some embodiments, amp2 is *T. reesei* amp2. The amino acid sequence encoded by *T. reesei* amp2 is set forth in SEQ ID NO: 775. In other embodiments, a protease of the present disclosure has an amino acid sequence having 50% or more identity (e.g. 60%, 65%, 70%, 75%, 80%, 85%, 90%, 91%, 92%, 93%, 94%, 95%, 96%, 97%, 98%, 99%, 99.5% or more) to SEQ ID NO: 775. In further embodiments, the protease has 100% identity to SEQ ID NO: 775.

Sep Proteases

Sep proteases are serine proteases belonging to the S28 subtype. They have a catalytic triad of serine, aspartate, and histidine: serine acts as a nucleophile, aspartate as an electrophile, and histidine as a base. These serine proteases include several eukaryotic enzymes such as lysosomal Pro-X carboxypeptidase, dipeptidyl-peptidase II, and thymus-specific serine peptidase.

Examples of suitable sep1 proteases include, without limitation, *Trichoderma reesei* sep1 124051 (SEQ ID NO: 786), *T. virens* 39211 (SEQ ID NO: 787), *T. atroviride* 296922 (SEQ ID NO: 788), *A. niger* CAK45422.1 (SEQ ID NO: 789), *A. fumigatus* EDP53789.1 (SEQ ID NO: 790), *N. crassa* XP_958301.1 (SEQ ID NO: 791), *M. thermophila* XP_003664601.1 (SEQ ID NO: 792), *M. graminicola* XP_384993.1 (SEQ ID NO: 793), *M. thermophila* XP_003658945.1 (SEQ ID NO: 794), *F. graminicola* XP_382380.1 (SEQ ID NO: 795), *A. niger* XP_001395660.1 (SEQ ID NO: 796), *M. thermophila* XP_003659734.1 (SEQ ID NO: 797), *N. crassa* XP_964374.1 (SEQ ID NO: 798), *A. fumigatus* XP_756068.1 (SEQ ID NO: 799), *A. oryzae* EIT77098.1 (SEQ ID NO: 800), *P. chrysogenum* XP_002560028.1 (SEQ ID NO: 801), *A. oryzae* EIT71569.1 (SEQ ID NO: 802), *A. nidulans* CBF79006.1 (SEQ ID NO: 803), *A. niger* XP_001400740.2 (SEQ ID NO: 804), *A. oryzae* BAE57999.1 (SEQ ID NO: 805), and homologs thereof.

Accordingly, in certain embodiments, a protease of the present disclosure, typically a sep1 protease, has an amino acid sequence having 50% or more identity (e.g. 60%, 65%, 70%, 75%, 80%, 85%, 90%, 91%, 92%, 93%, 94%, 95%, 96%, 97%, 98%, 99%, 99.5% or more to an amino acid sequence selected from SEQ ID NOs: 786-805. In some embodiments, the protease has 100% identity to an amino acid sequence selected from SEQ ID NOs: 786-805.

In some embodiments, sep1 is *T. reesei* sep1. The amino acid sequence encoded by *T. reesei* sep1 is set forth in SEQ ID NO: 786. In other embodiments, a protease of the present disclosure has an amino acid sequence having 50% or more identity (e.g. 60%, 65%, 70%, 75%, 80%, 85%, 90%, 91%, 92%, 93%, 94%, 95%, 96%, 97%, 98%, 99%, 99.5% or more) to SEQ ID NO: 786. In further embodiments, the protease has 100% identity to SEQ ID NO: 786.

Zinc Metalloprotease

Zinc metalloproteases are protease enzymes that require zinc for catalytic activity.

Five metalloproteases have been identified in *Trichoderma* fungal cells: mp1 (tre122703), mp2 (tre122576), mp3 (tre4308), mp4 (tre53343), mp5 (tre73809).

mp1, mp2, mp3, mp4 and mp5

Examples of suitable mp1, mp2, mp3, mp4 and mp5 proteases include, without limitation, *Trichoderma reesei* mp1 (SEQ ID NO: 875), *Trichoderma reesei* mp2 (SEQ ID NO:876), *Trichoderma reesei* mp3 (SEQ ID NO:877), *Trichoderma reesei* mp4 (SEQ ID NO:878), *Trichoderma reesei* mp5 (SEQ ID NO:879), and homologs thereof.

Accordingly, in certain embodiments, a protease of the present disclosure, typically a mp1, mp2, mp3, mp4 or mp5 protease, has an amino acid sequence having 50% or more identity (e.g. 60%, 65%, 70%, 75%, 80%, 85%, 90%, 91%, 92%, 93%, 94%, 95%, 96%, 97%, 98%, 99%, 99.5% or more to an amino acid sequence selected from SEQ ID NOs:875-879. In some embodiments, the protease has 100% identity to an amino acid sequence selected from SEQ ID NOs: 875-879.

Other Proteases

Examples of other suitable proteases include, without limitation,

*Trichoderma reesei* Group A protease selected from the group of protease65735 (SEQ ID NO:894), protease77577 (SEQ ID NO:895), protease81087 (SEQ ID NO:896), protease56920 (SEQ ID NO:900), protease122083 (SEQ ID NO:911), protease79485 (SEQ ID NO:910), protease120998 (SEQ ID NO:901), or protease61127 (SEQ ID NO:912;

*Trichoderma reesei* Group B protease selected from the group of protease21659 (SEQ ID NO:905), protease58387 (SEQ ID NO:921), protease75159 (SEQ ID NO:918), protease56853 (SEQ ID NO:914), or protease64193 (SEQ ID NO:908);

*Trichoderma reesei* Group C protease selected from the group of protease82452 (SEQ ID NO:906), protease80762 (SEQ ID NO:913), protease21668 (SEQ ID NO:919), protease81115 (SEQ ID NO:907), protease82141 (SEQ ID NO:902), protease23475 (SEQ ID NO:909);

*Trichoderma reesei* Group D protease selected from the group of protease121890 (903), protease22718 (SEQ ID NO:904), protease47127 (SEQ ID NO:899), protease61912 (SEQ ID NO:920), protease80843 (SEQ ID NO:897), protease66608 (SEQ ID NO:923), protease72612 (SEQ ID NO:898), protease40199 (SEQ ID NO:917); or

*Trichoderma reesei* Group E protease selected from the group of protease22210 (SEQ ID NO:915), protease111694 (SEQ ID NO:916), protease82577 (SEQ ID NO:922), and homologs thereof.

Accordingly, in certain embodiments, a protease of the present disclosure has an amino acid sequence having 50% or more identity (e.g. 60%, 65%, 70%, 75%, 80%, 85%, 90%, 91%, 92%, 93%, 94%, 95%, 96%, 97%, 98%, 99%, 99.5% or more to an amino acid sequence selected from SEQ ID NOs: 894-923). In some embodiments, the protease has 100% identity to an amino acid sequence selected from SEQ ID NOs: 894-923.

Homologous Proteases

Other embodiments of the present disclosure relate to reducing the activity of proteases that are homologous to the proteases of the present disclosure. "Homology" as used herein refers to sequence similarity between a reference sequence and at least a fragment of a second sequence. Homologs may be identified by any method known in the art, preferably, by using the BLAST tool to compare a reference sequence to a single second sequence or fragment of a sequence or to a database of sequences. As described below, BLAST will compare sequences based upon percent identity and similarity.

The terms "identical" or percent "identity," in the context of two or more nucleic acid or amino acid sequences, refers to two or more sequences or subsequences that are the same. Two sequences are "substantially identical" if two sequences have a specified percentage of amino acid residues or nucleotides that are the same (i.e., 29% identity, optionally 30%, 40%, 45%, 50%, 55%, 60%, 65%, 70%, 75%, 80%, 85%, 90%, 95%, 99% or 100% identity over a specified region, or, when not specified, over the entire sequence), when compared and aligned for maximum correspondence over a comparison window, or designated region as measured using one of the following sequence comparison algorithms or by manual alignment and visual inspection. Optionally, the identity exists over a region that is at least about 50 nucleotides (or 10 amino acids) in length, or more preferably over a region that is 100 to 500 or 1000 or more nucleotides (or 20, 50, 200, or more amino acids) in length.

For sequence comparison, typically one sequence acts as a reference sequence, to which test sequences are compared. When using a sequence comparison algorithm, test and reference sequences are entered into a computer, subsequence coordinates are designated, if necessary, and sequence algorithm program parameters are designated. Default program parameters can be used, or alternative parameters can be designated. The sequence comparison algorithm then calculates the percent sequence identities for the test sequences relative to the reference sequence, based on the program parameters. When comparing two sequences for identity, it is not necessary that the sequences be contiguous, but any gap would carry with it a penalty that would reduce the overall percent identity. For blastn, the default parameters are Gap opening penalty=5 and Gap extension penalty=2. For blastp, the default parameters are Gap opening penalty=11 and Gap extension penalty=1.

A "comparison window," as used herein, includes reference to a segment of any one of the number of contiguous positions including, but not limited to from 20 to 600, usually about 50 to about 200, more usually about 100 to about 150 in which a sequence may be compared to a reference sequence of the same number of contiguous positions after the two sequences are optimally aligned. Methods of alignment of sequences for comparison are well known in the art. Optimal alignment of sequences for comparison can be conducted, e.g., by the local homology algorithm of Smith and Waterman (1981), by the homology alignment algorithm of Needleman and Wunsch (1970) J Mol Biol 48(3):443-453, by the search for similarity method of Pearson and Lipman (1988) Proc Natl Acad Sci USA 85(8): 2444-2448, by computerized implementations of these algorithms (GAP, BESTFIT, FASTA, and TFASTA in the Wisconsin Genetics Software Package, Genetics Computer Group, 575 Science Dr., Madison, Wis.), or by manual alignment and visual inspection [see, e.g., Brent et al., (2003) Current Protocols in Molecular Biology, John Wiley & Sons, Inc. (Ringbou Ed)].

Two examples of algorithms that are suitable for determining percent sequence identity and sequence similarity are the BLAST and BLAST 2.0 algorithms, which are described in Altschul et al. (1997) Nucleic Acids Res 25(17): 3389-3402 and Altschul et al. (1990) J. Mol Biol 215(3)-403-410, respectively. Software for performing BLAST analyses is publicly available through the National Center for Biotechnology Information. This algorithm involves first identifying high scoring sequence pairs (HSPs) by identifying short words of length W in the query sequence, which either match or satisfy some positive-valued threshold score T when aligned with a word of the same length in a database sequence. T is referred to as the neighborhood word score threshold (Altschul et al., supra). These initial neighborhood word hits act as seeds for initiating searches to find longer HSPs containing them. The word hits are extended in both directions along each sequence for as far as the cumulative alignment score can be increased. Cumulative scores are calculated using, for nucleotide sequences, the parameters M (reward score for a pair of matching residues; always >0) and N (penalty score for mismatching residues; always <0). For amino acid sequences, a scoring matrix is used to calculate the cumulative score. Extension of the word hits in each direction are halted when: the cumulative alignment score falls off by the quantity X from its maximum achieved value; the cumulative score goes to zero or below, due to the accumulation of one or more negative-scoring residue alignments; or the end of either sequence is reached. The BLAST algorithm parameters W, T, and X determine the sensitivity and speed of the alignment. The BLASTN program (for nucleotide sequences) uses as defaults a wordlength (W) of 11, an expectation (E) or 10, M=5, N=−4, and a comparison of both strands. For amino acid sequences, the BLASTP program uses as defaults a wordlength of 3, and expectation (E) of 10, and the BLOSUM62 scoring matrix [see Henikoff and Henikoff, (1992) Proc Natl Acad Sci USA 89(22): 10915-109191 alignments (B) of 50, expectation (E) of 10, M=5, N=−4, and a comparison of both strands.

The BLAST algorithm also performs a statistical analysis of the similarity between two sequences (see, e.g., Karlin and Altschul, (1993) Proc Natl Acad Sci USA 90(12):5873-5877). One measure of similarity provided by the BLAST algorithm is the smallest sum probability (P(N)), which provides an indication of the probability by which a match between two nucleotide or amino acid sequences would occur by chance. For example, a nucleic acid is considered similar to a reference sequence if the smallest sum probability in a comparison of the test nucleic acid to the reference nucleic acid is less than about 0.2, more preferably less than about 0.01, and most preferably less than about 0.001.

Other than percentage of sequence identity noted above, another indication that two nucleic acid sequences or polypeptides are substantially identical is that the polypeptide encoded by the first nucleic acid is immunologically cross-reactive with the antibodies raised against the polypeptide encoded by the second nucleic acid, as described below. Thus, a polypeptide is typically substantially identical to a second polypeptide, for example, where the two peptides differ only by conservative substitutions. Another indication that two nucleic acid sequences are substantially identical is that the two molecules or their complements hybridize to each other under stringent conditions, as described below. Yet another indication that two nucleic acid sequences are substantially identical is that the same primers can be used to amplify the sequence.

As disclosed herein, proteases of the present disclosure may also include proteases that are conservatively modified variants of proteases encoded by the protease genes disclosed above. "Conservatively modified variants" as used herein include individual substitutions, deletions or additions to an encoded amino acid sequence which result in the substitution of an amino acid with a chemically similar amino acid. Conservative substitution tables providing functionally similar amino acids are well known in the art. Such conservatively modified variants are in addition to and do not exclude polymorphic variants, interspecies homologs, and alleles of the disclosure. The following eight groups contain amino acids that are conservative substitutions for one another: 1) Alanine (A), Glycine (G); 2) Aspartic acid (D), Glutamic acid (E); 3) Asparagine (N), Glutamine (Q); 4) Arginine (R), Lysine (K); 5) Isoleucine (I), Leucine (L), Methionine (M), Valine (V); 6) Phenylalanine (F), Tyrosine (Y), Tryptophan (W); 7) Serine (S), Threonine (T); and 8) Cysteine (C), Methionine (M) (see, e.g., Creighton, Proteins (1984)).

Phylogenetic trees of aspartic, subtilisin, glutamic and sedolisin proteases of selected filamentous fungi are described in WO2013/102674.

Methods of Reducing the Activity of Proteases of the Invention

Further aspects of the present disclosure relate to reducing the activity of proteases found in filamentous fungal cells that express a heterologous polypeptide, such a mammalian polypeptide.

The activity of proteases found in filamentous fungal cells can be reduced by any method known to those of skill in the art.

In some embodiments reduced activity of proteases is achieved by reducing the expression of the protease, for example, by promoter modification or RNAi.

In other embodiments, reduced activity of proteases is achieved by modifying the gene encoding the protease. Examples of such modifications include, without limitation, a knock-out mutation, a truncation mutation, a point mutation, a missense mutation, a substitution mutation, a frame-shift mutation, an insertion mutation, a duplication mutation, an amplification mutation, a translocation mutation, or an inversion mutation, and that results in a reduction in the corresponding protease activity. Methods of generating at least one mutation in a protease encoding gene of interest are well known in the art and include, without limitation, random mutagenesis and screening, site-directed mutagenesis, PCR mutagenesis, insertional mutagenesis, chemical mutagenesis, and irradiation.

In certain embodiments, a portion of the protease encoding gene is modified, such as the region encoding the catalytic domain, the coding region, or a control sequence required for expression of the coding region. Such a control sequence of the gene may be a promoter sequence or a functional part thereof, i.e., a part that is sufficient for affecting expression of the gene. For example, a promoter sequence may be inactivated resulting in no expression or a weaker promoter may be substituted for the native promoter sequence to reduce expression of the coding sequence. Other control sequences for possible modification include, without limitation, a leader sequence, a propeptide sequence, a signal sequence, a transcription terminator, and a transcriptional activator.

Protease encoding genes of the present disclosure that are present in filamentous fungal cells that express a recombinant polypeptide may also be modified by utilizing gene deletion techniques to eliminate or reduce expression of the gene. Gene deletion techniques enable the partial or complete removal of the gene thereby eliminating their expression. In such methods, deletion of the gene may be accomplished by homologous recombination using a plasmid that has been constructed to contiguously contain the 5' and 3' regions flanking the gene.

The protease encoding genes of the present disclosure that are present in filamentous fungal cells that express a recombinant polypeptide may also be modified by introducing, substituting, and/or removing one or more nucleotides in the gene, or a control sequence thereof required for the transcription or translation of the gene. For example, nucleotides may be inserted or removed for the introduction of a stop codon, the removal of the start codon, or a frame-shift of the open reading frame. Such a modification may be accomplished by methods known in the art, including without limitation, site-directed mutagenesis and peR generated mutagenesis (see, for example, Botstein and Shortie, 1985, *Science* 229: 4719; Lo et al., 1985, *Proceedings of the National Academy of Sciences USA* 81: 2285; Higuchi et al., 1988, *Nucleic Acids Research* 16: 7351; Shimada, 1996, *Meth. Mol. Biol.* 57: 157; Ho et al., 1989, *Gene* 77: 61; Horton et al., 1989, *Gene* 77: 61; and Sarkar and Sommer, 1990, *BioTechniques* 8: 404).

Additionally, protease encoding genes of the present disclosure that are present in filamentous fungal cells that express a recombinant polypeptide may be modified by gene disruption techniques by inserting into the gene a disruptive nucleic acid construct containing a nucleic acid fragment homologous to the gene that will create a duplication of the region of homology and incorporate construct DNA between the duplicated regions. Such a gene disruption can eliminate gene expression if the inserted construct separates the promoter of the gene from the coding region or interrupts the coding sequence such that a nonfunctional gene product results. A disrupting construct may be simply a selectable marker gene accompanied by 5' and 3' regions homologous to the gene. The selectable marker enables identification of transformants containing the disrupted gene.

Protease encoding genes of the present disclosure that are present in filamentous fungal cells that express a recombinant polypeptide may also be modified by the process of gene conversion (see, for example, Iglesias and Trautner, 1983, *Molecular General Genetics* 189:5 73-76). For example, in the gene conversion a nucleotide sequence corresponding to the gene is mutagenized in vitro to produce a defective nucleotide sequence, which is then transformed into a *Trichoderma* strain to produce a defective gene. By homologous recombination, the defective nucleotide sequence replaces the endogenous gene. It may be desirable that the defective nucleotide sequence also contains a marker for selection of transformants containing the defective gene.

Protease encoding genes of the present disclosure that are present in filamentous fungal cells that express a recombinant polypeptide may also be modified by established antisense techniques using a nucleotide sequence complementary to the nucleotide sequence of the gene (see, for example, Parish and Stoker, 1997, *FEMS Microbiology Letters* 154: 151-157). In particular, expression of the gene by filamentous fungal cells may be reduced or inactivated by introducing a nucleotide sequence complementary to the nucleotide sequence of the gene, which may be transcribed in the strain and is capable of hybridizing to the mRNA produced in the cells. Under conditions allowing the complementary anti-sense nucleotide sequence to hybridize to the mRNA, the amount of protein translated is thus reduced or eliminated.

In addition, protease encoding genes of the present disclosure that are present in filamentous fungal cells that express a recombinant polypeptide may also be modified by established RNA interference (RNAi) techniques (see, for example, WO 2005/056772 and WO 2008/080017).

Protease encoding genes of the present disclosure that are present in filamentous fungal cells that express a recombinant polypeptide may also be modified by random or specific mutagenesis using methods well known in the art, including without limitation, chemical mutagenesis (see, for example, Hopwood, *The Isolation of Mutants in Methods in Microbiology* (J. R. Norris and D. W. Ribbons, eds.) pp. 363-433, Academic Press, New York, 25 1970). Modification of the gene may be performed by subjecting filamentous fungal cells to mutagenesis and screening for mutant cells in which expression of the gene has been reduced or inactivated. The mutagenesis, which may be specific or random, may be performed, for example, by use of a suitable physical or chemical mutagenizing agent, use of a suitable oligonucleotide, subjecting the DNA sequence to peR generated mutagenesis, or any combination thereof. Examples of physical and chemical mutagenizing agents include, without limitation, ultraviolet (UV) irradiation, hydroxylamine, N-methyl-N'-nitro-N-nitrosoguanidine (MNNG), N-methyl-N'-nitrosogaunidine (NTG) O-methyl hydroxylamine, nitrous acid, ethyl methane sulphonate (EMS), sodium bisulphite, formic acid, and nucleotide analogues. When such agents are used, the mutagenesis is typically performed by incubating the *Trichoderma* cells to be mutagenized in the presence of the mutagenizing agent of choice under suitable conditions, and then selecting for mutants exhibiting reduced or no expression of the gene.

In certain embodiments, the at least one mutation or modification in a protease encoding gene of the present disclosure results in a modified protease that has no detectable protease activity. In other embodiments, the at least one modification in a protease encoding gene of the present disclosure results in a modified protease that has at least 25% less, at least 50% less, at least 75% less, at least 90%, at least 95%, at least 100%, at least 200%, at least 300%, at least 400%, at least 500%, at least 600%, at least 700%, at least 800%, at least 900%, at least 1,000%, or a higher percentage less protease activity compared to a corresponding non-modified protease.

In certain embodiments, for example, in a *Trichoderma* cell, the at least one mutation or modification in a protease encoding gene of the present disclosure results in a reduction of total protease activity to 49% or less, typically with a mutation in at least 2 distinct protease genes, or 31% or less, typically with a mutation in at least 3 distinct protease genes, or 13% or less, typically with a mutation in at least 4 distinct protease genes, or 10% or less, typically with a mutation in at least 5 distinct protease genes, or 6.3% or less, typically with a mutation in at least 6 distinct protease genes, or 5.5% or less, typically with a mutation in at least 7 distinct protease genes, of the total protease activity of the corresponding parental *Trichoderma* cell.

Heterologous Polypeptides of the Invention

The invention herein further relates to increasing the production of heterologous polypeptides in filamentous fungal cells that express such heterologous polypeptides by reducing the activity of proteases found in the cells.

As used herein a "heterologous polypeptide" refers to a polypeptide that is not naturally found in (i.e., endogenous) a filamentous fungal cell of the present disclosure, or that is expressed at an elevated level in a filamentous fungal cell as compared to the endogenous version of the polypeptide. In certain embodiments, the heterologous polypeptide is a mammalian polypeptide. In other embodiments, the heterologous polypeptide is a non-mammalian polypeptide.

Mammalian Polypeptides

Mammalian polypeptides of the present disclosure may be any mammalian polypeptide having a biological activity of interest. As used herein, a "mammalian polypeptide" is a polypeptide that is natively expressed in a mammal, a polypeptide that is derived from a polypeptide that is natively expressed in a mammal, or a fragment thereof. A mammalian polypeptide also includes peptides and oligopeptides that retain biological activity. Mammalian polypeptides of the present disclosure may also include two or more polypeptides that are combined to form the encoded product. Mammalian polypeptides of the present disclosure may further include fusion polypeptides, which contain a combination of partial or complete amino acid sequences obtained from at least two different polypeptides. Mammalian polypeptides may also include naturally occurring allelic and engineered variations of any of the disclosed mammalian polypeptides and hybrid mammalian polypeptides.

The mammalian polypeptide may be a naturally glycosylated polypeptide or a naturally non-glycosylated polypeptide.

Examples of suitable mammalian polypeptides include, without limitation, immunoglobulins, antibodies, antigens, antimicrobial peptides, enzymes, growth factors, hormones, interferons, cytokines, interleukins, immunodilators, neurotransmitters, receptors, reporter proteins, structural proteins, and transcription factors.

Specific examples of suitable mammalian polypeptides include, without limitation, immunoglobulins, immunoglobulin heavy chains, immunoglobulin light chains, monoclonal antibodies, hybrid antibodies, F(ab')2 antibody fragments, F(ab) antibody fragments, Fv molecules, single-chain Fv antibodies, dimeric antibody fragments, trimeric antibody fragments, functional antibody fragments, immunoadhesins, insulin-like growth factor 1, growth hormone, insulin, interferon alpha 2b, fibroblast growth factor 21, human serum albumin, camelid antibodies and/or antibody fragments, single domain antibodies, multimeric single domain antibodies, and erythropoietin.

Other examples of suitable mammalian proteins include, without limitation, an oxidoreductase, a transferase, a hydrolase, a lyase, an isomerase, a ligase, an aminopeptidase, an amylase, a carbohydrase, a carboxypeptidase, a catalase, a glycosyltransferase, a deoxyribonuclease, an esterase, a galactosidase, a betagalactosidase, a glucosidase, a glucuronidase, a glucuronoyl esterase, a haloperoxidase, an invertase, a lipase, an oxidase, a phospholipase, a proteolytic enzyme, a ribonuclease, a urokinase, an albumin, a collagen, a tropoelastin, and an elastin.

Non-Mammalian Polypeptides

Non-mammalian polypeptides of the present disclosure may be any non-mammalian polypeptide having a biological activity of interest. As used herein, a "non-mammalian polypeptide" is a polypeptide that is natively expressed in a non-mammalian organism, such as a fungal cell, a polypeptide that is derived from a polypeptide that is natively expressed in a non-mammal organism, or a fragment thereof. A non-mammalian polypeptide also includes peptides and oligopeptides that retain biological activity. Non-mammalian polypeptides of the present disclosure may also include two or more polypeptides that are combined to form the encoded product. Non-mammalian polypeptides of the present disclosure may further include fusion polypeptides, which contain a combination of partial or complete amino acid sequences obtained from at least two different polypeptides. Non-mammalian polypeptides may also include naturally occurring allelic and engineered variations of any of the disclosed non-mammalian polypeptides and hybrid non-mammalian polypeptides.

Examples of suitable non-mammalian polypeptides include, without limitation, aminopeptidases, amylases, carbohydrases, carboxypeptidases, catalases, cellulases, chitinases, cutinases, deoxyribonucleases, esterases, alpha-galactosidases, beta-galactosidases, glucoamylases, alpha-glucosidases, beta-glucosidases, invertases, laccases, lipases, mutanases, oxidases, pectinolytic enzymes, peroxidases, phospholipases, phytases, polyphenoloxidases, proteolytic enzymes, ribonucleases, transglutaminases and xylanases.

Heterologous Polypeptide Production

A heterologous polypeptide of interest is produced by filamentous fungal cells of the present disclosure containing at least three proteases having reduced activity by cultivating the cells in a nutrient medium for production of the heterologous polypeptide using methods known in the art. For example, the cells may be cultivated by shake flask cultivation, small-scale or large-scale fermentation (including continuous, batch, fed-batch, or solid state fermentations) in laboratory or industrial fermentors performed in a suitable medium and under conditions allowing the polypeptide to be expressed and/or isolated. The cultivation takes place in a suitable nutrient medium comprising carbon and nitrogen sources and inorganic salts, using procedures known in the art. Suitable media are available from commercial suppliers or may be prepared according to published compositions (e.g., in catalogues of the American Type Culture Collection). The secreted polypeptide can be recovered directly from the medium. If the polypeptide is not secreted, it may be obtained from cell lysates.

A heterologous polypeptide of interest produced by a filamentous fungal cell of the present disclosure containing at least three proteases having reduced activity may be detected using methods known in the art that are specific for the heterologous polypeptide. These detection methods may include, without limitation, use of specific antibodies, high performance liquid chromatography, capillary chromatography, formation of an enzyme product, disappearance of an enzyme substrate, and SDS-PAGE. For example, an enzyme assay may be used to determine the activity of an enzyme. Procedures for determining enzyme activity are known in the art for many enzymes (see, for example, O. Schomburg and M. Salzmann (eds.), *Enzyme Handbook*, Springer-Verlag, New York, 1990).

The resulting heterologous polypeptide may be isolated by methods known in the art. For example, a heterologous polypeptide of interest may be isolated from the cultivation medium by conventional procedures including, without limitation, centrifugation, filtration, extraction, spray-drying, evaporation, and precipitation. The isolated heterologous polypeptide may then be further purified by a variety of procedures known in the art including, without limitation, chromatography (e.g., ion exchange, affinity, hydrophobic, chromatofocusing, and size exclusion), electrophoretic procedures (e.g., preparative isoelectric focusing (IEF), differential solubility (e g, ammonium sulfate precipitation), or extraction (see, for example, *Protein Purification*, J.-C. Janson and Lars Ryden, editors, VCH Publishers, New York, 1989).

Preparation of Polynucleotides Encoding Heterologous Polypeptides

Sequences of the heterologous polynucleotides of the present disclosure are prepared by any suitable method known in the art, including, without limitation, direct chemical synthesis or cloning. For direct chemical synthesis, formation of a polymer of nucleic acids typically involves sequential addition of 3 '-blocked and 5'-blocked nucleotide monomers to the terminal 5'-hydroxyl group of a growing nucleotide chain, wherein each addition is effected by nucleophilic attack of the terminal 5'-hydroxyl group of the growing chain on the 3'-position of the added monomer, which is typically a phosphorus derivative, such as a phosphotriester, phosphoramidite, or the like. Such methodology is known to those of ordinary skill in the art and is described in the pertinent texts and literature [e.g., in Matteucci et al., (1980) Tetrahedron Lett 21:719-722; U.S. Pat. Nos. 4,500, 707; 5,436,327; and 5,700,637]. In addition, the desired sequences may be isolated from natural sources by splitting DNA using appropriate restriction enzymes, separating the fragments using gel electrophoresis, and thereafter, recovering the desired nucleic acid sequence from the gel via techniques known to those of ordinary skill in the art, such as utilization of polymerase chain reactions (PCR; e.g., U.S. Pat. No. 4,683,195).

Each heterologous polynucleotide of the present disclosure can be incorporated into an expression vector. "Expression vector" or "vector" refers to a compound and/or composition that transduces, transforms, or infects a host cell, thereby causing the cell to express nucleic acids and/or proteins other than those native to the cell, or in a manner not native to the cell. An "expression vector" contains a sequence of nucleic acids (ordinarily RNA or DNA) to be expressed by the host cell. Optionally, the expression vector also includes materials to aid in achieving entry of the nucleic acid into the host cell, such as a virus, liposome, protein coating, or the like. The expression vectors contemplated for use in the present disclosure include those into which a nucleic acid sequence can be inserted, along with any preferred or required operational elements. Further, the expression vector must be one that can be transferred into a host cell and replicated therein. Preferred expression vectors are plasmids, particularly those with restriction sites that have been well documented and that contain the operational elements preferred or required for transcription of the nucleic acid sequence. Such plasmids, as well as other expression vectors, are well known in the art.

Incorporation of the individual polynucleotides may be accomplished through known methods that include, for example, the use of restriction enzymes (such as BamHI, EcoRI, HhaI, XhoI, XmaI, and so forth) to cleave specific sites in the expression vector, e.g., plasmid. The restriction enzyme produces single stranded ends that may be annealed to a polynucleotide having, or synthesized to have, a terminus with a sequence complementary to the ends of the cleaved expression vector. Annealing is performed using an appropriate enzyme, e.g., DNA ligase. As will be appreciated by those of ordinary skill in the art, both the expression vector and the desired polynucleotide are often cleaved with the same restriction enzyme, thereby assuring that the ends of the expression vector and the ends of the polynucleotide are complementary to each other. In addition, DNA linkers maybe used to facilitate linking of nucleic acids sequences into an expression vector.

A series of individual polynucleotides can also be combined by utilizing methods that are known t in the art (e.g., U.S. Pat. No. 4,683,195).

For example, each of the desired polynucleotides can be initially generated in a separate PCR. Thereafter, specific primers are designed such that the ends of the PCR products contain complementary sequences. When the PCR products are mixed, denatured, and reannealed, the strands having the matching sequences at their 3' ends overlap and can act as primers for each other. Extension of this overlap by DNA polymerase produces a molecule in which the original sequences are "spliced" together. In this way, a series of individual polynucleotides may be "spliced" together and subsequently transduced into a host cell simultaneously. Thus, expression of each of the plurality of polynucleotides is affected.

Individual polynucleotides, or "spliced" polynucleotides, are then incorporated into an expression vector. The present disclosure is not limited with respect to the process by which the polynucleotide is incorporated into the expression vector. Those of ordinary skill in the art are familiar with the necessary steps for incorporating a polynucleotide into an expression vector. A typical expression vector contains the desired polynucleotide preceded by one or more regulatory regions, along with a ribosome binding site, e.g., a nucleotide sequence that is 3-9 nucleotides in length and located 3-11 nucleotides upstream of the initiation codon in $E.\ coli$. See Shine and Dalgarno (1975) Nature 254(5495):34-38 and Steitz (1979) Biological Regulation and Development (ed. Goldberger, R. F.), 1:349-399 (Plenum, New York).

The term "operably linked" as used herein refers to a configuration in which a control sequence is placed at an appropriate position relative to the coding sequence of the DNA sequence or polynucleotide such that the control sequence directs the expression of a polypeptide.

Regulatory regions include, for example, those regions that contain a promoter and an operator. A promoter is operably linked to the desired polynucleotide, thereby initiating transcription of the polynucleotide via an RNA polymerase enzyme. An operator is a sequence of nucleic acids adjacent to the promoter, which contains a protein-binding domain where a repressor protein can bind. In the absence of a repressor protein, transcription initiates through the promoter. When present, the repressor protein specific to the protein-binding domain of the operator binds to the operator, thereby inhibiting transcription. In this way, control of transcription is accomplished, based upon the particular regulatory regions used and the presence or absence of the corresponding repressor protein. Examples include lactose promoters (LacI repressor protein changes conformation when contacted with lactose, thereby preventing the LacI repressor protein from binding to the operator) and tryptophan promoters (when complexed with tryptophan, TrpR repressor protein has a conformation that binds the operator; in the absence of tryptophan, the TrpR repressor protein has a conformation that does not bind to the operator). Another example is the tac promoter (see de Boer et al., (1983) Proc Natl Acad Sci USA 80(1):21-25). As will be appreciated by those of ordinary skill in the art, these and other expression vectors may be used in the present disclosure, and the present disclosure is not limited in this respect.

Although any suitable expression vector may be used to incorporate the desired sequences, readily available expression vectors include, without limitation: plasmids, such as pSC1O1, pBR322, pBBR1MCS-3, pUR, pEX, pMR100, pCR4, pBAD24, pUC19, pRS426; and bacteriophages, such as M13 phage and λ phage. Of course, such expression vectors may only be suitable for particular host cells. One of ordinary skill in the art, however, can readily determine through routine experimentation whether any particular expression vector is suited for any given host cell. For example, the expression vector can be introduced into the host cell, which is then monitored for viability and expression of the sequences contained in the vector. In addition, reference may be made to the relevant texts and literature, which describe expression vectors and their suitability to any particular host cell.

Suitable expression vectors for the purposes of the invention, including the expression of the desired heterologous polypeptide, enzyme, and one or more catalytic domains described herein, include expression vectors containing the polynucleotide encoding the desired heterologous polypeptide, enzyme, or catalytic domain(s) operably linked to a constitutive or an inducible promoter. Examples of particularly suitable promoters for operable linkage to such polynucleotides include promoters from the following genes: gpdA, cbh1, *Aspergillus oryzae* TAKA amylase, *Rhizomucor miehei* aspartic proteinase, *Aspergillus niger* neutral alpha-amylase, *Aspergillus niger* acid stable alpha-amylase, *Aspergillus niger* glucoamylase (glaA), *Aspergillus awamori* glaA, *Rhizomucor miehei* lipase, *Aspergillus oryzae* alkaline protease, *Aspergillus oryzae* triose phosphate isomerase, *Aspergillus nidulans* acetamidase, *Aspergillus oryzae* acetamidase, *Fusarium oxysporum* trypsin-like protease, fungal endo α-L-arabinase (abnA), fungal α-L-arabinofuranosidase A (abfA), fungal α-L-arabinofuranosidase B (abfB), fungal xylanase (xlnA), fungal phytase, fungal ATP-synthetase, fungal subunit 9 (oliC), fungal triose phosphate isomerase (tpi), fungal alcohol dehydrogenase (adhA), fungal α-amylase (amy), fungal amyloglucosidase (glaA), fungal acetamidase (amdS), fungal glyceraldehyde-3-phosphate dehydrogenase (gpd), yeast alcohol dehydrogenase, yeast lactase, yeast 3-phosphoglycerate kinase, yeast triosephosphate isomerase, bacterial α-amylase, bacterial Spo2, and SSO. Examples of such suitable expression vectors and promoters are also described in WO2012/069593, the entire contents of which is hereby incorporated by reference herein.

Pharmaceutical Compositions Containing Heterologous Polypeptides Produced by Filamentous Fungal Cells of the Invention In another aspect, the present invention provides a composition, e.g., a pharmaceutical composition, containing one or more heterologous polypeptides of interest, such as mammalian polypeptides, produced by the filamentous fungal cells of the present disclosure having reduced activity of at least three proteases and further containing a recombinant polynucleotide encoding the heterologous polypeptide, formulated together with a pharmaceutically acceptable carrier. Pharmaceutical compositions of the invention also can be administered in combination therapy, i.e., combined with other agents. For example, the combination therapy can include a mammalian polypeptide of interest combined with at least one other therapeutic agent.

As used herein, "pharmaceutically acceptable carrier" includes any and all solvents, dispersion media, coatings, antibacterial and antifungal agents, isotonic and absorption delaying agents, and the like that are physiologically compatible. Preferably, the carrier is suitable for intravenous, intramuscular, subcutaneous, parenteral, spinal or epidermal administration (e.g., by injection or infusion). Depending on the route of administration, the active compound, i.e., the mammalian polypeptide of interest, may be coated in a material to protect the compound from the action of acids and other natural conditions that may inactivate the compound.

The pharmaceutical compositions of the invention may include one or more pharmaceutically acceptable salts. A "pharmaceutically acceptable salt" refers to a salt that retains the desired biological activity of the parent compound and does not impart any undesired toxicological effects (see e.g., Berge, S. M., et al. (1977) J. Pharm. Sci. 66:1-19). Examples of such salts include acid addition salts and base addition salts. Acid addition salts include those derived from nontoxic inorganic acids, such as hydrochloric, nitric, phosphoric, sulfuric, hydrobromic, hydroiodic, phosphorous and the like, as well as from nontoxic organic acids such as aliphatic mono- and dicarboxylic acids, phenyl-substituted alkanoic acids, hydroxy alkanoic acids, aromatic acids, aliphatic and aromatic sulfonic acids and the like. Base addition salts include those derived from alkaline earth metals, such as sodium, potassium, magnesium, calcium and the like, as well as from nontoxic organic amines, such as N,N'-dibenzylethylenediamine, N-methylglucamine, chloroprocaine, choline, diethanolamine, ethylenediamine, procaine and the like.

A pharmaceutical composition of the invention also may also include a pharmaceutically acceptable antioxidant. Examples of pharmaceutically acceptable antioxidants include: (1) water soluble antioxidants, such as ascorbic acid, cysteine hydrochloride, sodium bisulfate, sodium metabisulfite, sodium sulfite and the like; (2) oil-soluble antioxidants, such as ascorbyl palmitate, butylated hydroxyanisole (BHA), butylated hydroxytoluene (BHT), lecithin, propyl gallate, alpha-tocopherol, and the like; and (3) metal chelating agents, such as citric acid, ethylenediamine tetraacetic acid (EDTA), sorbitol, tartaric acid, phosphoric acid, and the like.

Examples of suitable aqueous and nonaqueous carriers that may be employed in the pharmaceutical compositions of the invention include water, ethanol, polyols (such as glycerol, propylene glycol, polyethylene glycol, and the like), and suitable mixtures thereof, vegetable oils, such as olive oil, and injectable organic esters, such as ethyl oleate. Proper fluidity can be maintained, for example, by the use of coating materials, such as lecithin, by the maintenance of the required particle size in the case of dispersions, and by the use of surfactants.

These compositions may also contain adjuvants such as preservatives, wetting agents, emulsifying agents and dispersing agents. Prevention of presence of microorganisms may be ensured both by sterilization procedures, and by the inclusion of various antibacterial and antifungal agents, for example, paraben, chlorobutanol, phenol sorbic acid, and the like. It may also be desirable to include isotonic agents, such as sugars, sodium chloride, and the like into the compositions. In addition, prolonged absorption of the injectable pharmaceutical form may be brought about by the inclusion of agents which delay absorption such as aluminum monostearate and gelatin.

Pharmaceutically acceptable carriers include sterile aqueous solutions or dispersions and sterile powders for the extemporaneous preparation of sterile injectable solutions or dispersion. The use of such media and agents for pharmaceutically active substances is known in the art. Except insofar as any conventional media or agent is incompatible with the active compound, use thereof in the pharmaceutical compositions of the invention is contemplated. Supplementary active compounds can also be incorporated into the compositions.

Therapeutic compositions typically must be sterile and stable under the conditions of manufacture and storage. The composition can be formulated as a solution, microemulsion, liposome, or other ordered structure suitable to high drug concentration. The carrier can be a solvent or dispersion medium containing, for example, water, ethanol, polyol (for example, glycerol, propylene glycol, and liquid polyethylene glycol, and the like), and suitable mixtures thereof. The proper fluidity can be maintained, for example, by the use of a coating such as lecithin, by the maintenance of the required particle size in the case of dispersion and by the use of surfactants. In many cases, it will be preferable to include isotonic agents, for example, sugars, polyalcohols such as mannitol, sorbitol, or sodium chloride in the composition. Prolonged absorption of the injectable compositions can be brought about by including in the composition an agent that delays absorption, for example, monostearate salts and gelatin.

Sterile injectable solutions can be prepared by incorporating the active compound in the required amount in an appropriate solvent with one or a combination of ingredients enumerated above, as required, followed by sterilization microfiltration. Generally, dispersions are prepared by incorporating the active compound into a sterile vehicle that contains a basic dispersion medium and the required other ingredients from those enumerated above. In the case of sterile powders for the preparation of sterile injectable solutions, the certain methods of preparation are vacuum drying and freeze-drying (lyophilization) that yield a powder of the active ingredient plus any additional desired ingredient from a previously sterile-filtered solution thereof.

The amount of active ingredient which can be combined with a carrier material to produce a single dosage form will vary depending upon the subject being treated, and the particular mode of administration. The amount of active ingredient which can be combined with a carrier material to produce a single dosage form will generally be that amount of the composition which produces a therapeutic effect. Generally, out of one hundred percent, this amount will range from about 0.01 percent to about ninety-nine percent of active ingredient, preferably from about 0.1 percent to about 70 percent, most preferably from about 1 percent to about 30 percent of active ingredient in combination with a pharmaceutically acceptable carrier.

Dosage regimens are adjusted to provide the optimum desired response (e.g., a therapeutic response). For example, a single bolus may be administered, several divided doses may be administered over time or the dose may be proportionally reduced or increased as indicated by the exigencies of the therapeutic situation. It is especially advantageous to formulate parenteral compositions in dosage unit form for ease of administration and uniformity of dosage. Dosage unit form as used herein refers to physically discrete units suited as unitary dosages for the subjects to be treated; each unit contains a predetermined quantity of active compound calculated to produce the desired therapeutic effect in association with the required pharmaceutical carrier. The specification for the dosage unit forms of the invention are dictated by and directly dependent on (a) the unique characteristics of the active compound and the particular therapeutic effect to be achieved, and (b) the limitations inherent in the art of compounding such an active compound for the treatment of sensitivity in individuals.

For administration of a mammalian polypeptide of interest, in particular where the mammalian polypeptide is an antibody, the dosage ranges from about 0.0001 to 100 mg/kg, and more usually 0.01 to 5 mg/kg, of the host body weight. For example, dosages can be 0.3 mg/kg body weight, 1 mg/kg body weight, 3 mg/kg body weight, 5 mg/kg body weight or 10 mg/kg body weight or within the range of 1-10 mg/kg. An exemplary treatment regime entails administration once per week, once every two weeks, once every three weeks, once every four weeks, once a month, once every 3 months or once every three to 6 months. Certain dosage regimens for an antibody may include 1 mg/kg body weight or 3 mg/kg body weight via intravenous administration, with the antibody being given using one of the following dosing schedules: (i) every four weeks for six dosages, then every three months; (ii) every three weeks; (iii) 3 mg/kg body weight once followed by 1 mg/kg body weight every three weeks.

Alternatively a mammalian polypeptide of interest can be administered as a sustained release formulation, in which case less frequent administration is required. Dosage and frequency vary depending on the half-life of the administered substance in the patient. In general, human antibodies show the longest half life, followed by humanized antibodies, chimeric antibodies, and nonhuman antibodies. The dosage and frequency of administration can vary depending on whether the treatment is prophylactic or therapeutic. In prophylactic applications, a relatively low dosage is administered at relatively infrequent intervals over a long period of time. Some patients continue to receive treatment for the rest of their lives. In therapeutic applications, a relatively high dosage at relatively short intervals is sometimes required until progression of the disease is reduced or terminated, and preferably until the patient shows partial or complete amelioration of symptoms of disease. Thereafter, the patient can be administered a prophylactic regime.

Actual dosage levels of the active ingredients in the pharmaceutical compositions of the present disclosure may be varied so as to obtain an amount of the active ingredient which is effective to achieve the desired therapeutic response for a particular patient, composition, and mode of administration, without being toxic to the patient. The selected dosage level will depend upon a variety of pharmacokinetic factors including the activity of the particular compositions of the present invention employed, or the ester, salt or amide thereof, the route of administration, the time of administration, the rate of excretion of the particular compound being employed, the duration of the treatment, other drugs, compounds and/or materials used in combination with the particular compositions employed, the age, sex, weight, condition, general health and prior medical history of the patient being treated, and like factors well known in the medical arts.

A "therapeutically effective dosage" of an immunoglobulin of the present disclosure preferably results in a decrease in severity of disease symptoms, an increase in frequency and duration of disease symptom-free periods, or a prevention of impairment or disability due to the disease affliction. For example, for the treatment of tumors, a "therapeutically effective dosage" preferably inhibits cell growth or tumor growth by at least about 20%, more preferably by at least about 40%, even more preferably by at least about 60%, and still more preferably by at least about 80% relative to untreated subjects. The ability of a compound to inhibit tumor growth can be evaluated in an animal model system predictive of efficacy in human tumors. Alternatively, this property of a composition can be evaluated by examining the ability of the compound to inhibit, such inhibition in vitro by assays known to the skilled practitioner. A therapeutically effective amount of a therapeutic compound can decrease tumor size, or otherwise ameliorate symptoms in a subject. One of ordinary skill in the art would be able to determine such amounts based on such factors as the subject's size, the severity of the subject's symptoms, and the particular composition or route of administration selected.

A composition of the present disclosure can be administered via one or more routes of administration using one or more of a variety of methods known in the art. As will be appreciated by the skilled artisan, the route and/or mode of administration will vary depending upon the desired results. Certain routes of administration for binding moieties of the invention include intravenous, intramuscular, intradermal, intraperitoneal, subcutaneous, spinal or other parenteral routes of administration, for example by injection or infusion. The phrase "parenteral administration" as used herein means modes of administration other than enteral and topical administration, usually by injection, and includes, without limitation, intravenous, intramuscular, intraarterial, intrathecal, intracapsular, intraorbital, intracardiac, intradermal, intraperitoneal, transtracheal, subcutaneous, subcuticular, intraarticular, subcapsular, subarachnoid, intraspinal, epidural and intrasternal injection and infusion.

Alternatively, a mammalian polypeptide according to the present disclosure can be administered via a nonparenteral route, such as a topical, epidermal or mucosal route of administration, for example, intranasally, orally, vaginally, rectally, sublingually or topically.

The active compounds can be prepared with carriers that will protect the compound against rapid release, such as a controlled release formulation, including implants, transdermal patches, and microencapsulated delivery systems. Biodegradable, biocompatible polymers can be used, such as ethylene vinyl acetate, polyanhydrides, polyglycolic acid, collagen, polyorthoesters, and polylactic acid. Many methods for the preparation of such formulations are patented or generally known to those skilled in the art. (see, e.g., *Sustained and Controlled Release Drug Delivery Systems*, J. R. Robinson, ed., Marcel Dekker, Inc., New York, 1978).

Therapeutic compositions can be administered with medical devices known in the art. For example, in a certain embodiment, a therapeutic composition of the invention can be administered with a needleless hypodermic injection device, such as the devices disclosed in U.S. Pat. Nos. 5,399,163; 5,383,851; 5,312,335; 5,064,413; 4,941,880; 4,790,824; or 4,596,556. Examples of well-known implants and modules useful in the present invention include: U.S. Pat. No. 4,487,603, which discloses an implantable microinfusion pump for dispensing medication at a controlled rate; U.S. Pat. No. 4,486,194, which discloses a therapeutic device for administering medicants through the skin; U.S. Pat. No. 4,447,233, which discloses a medication infusion pump for delivering medication at a precise infusion rate; U.S. Pat. No. 4,447,224, which discloses a variable flow implantable infusion apparatus for continuous drug delivery; U.S. Pat. No. 4,439,196, which discloses an osmotic drug delivery system having multi-chamber compartments; and U.S. Pat. No. 4,475,196, which discloses an osmotic drug delivery system.

In certain embodiments, the use of mammalian polypeptides according to the present disclosure is for the treatment of any disease that may be treated with therapeutic antibodies.

Filamentous Fungal Cells of the Invention

The invention herein also relates to increasing the levels of production of heterologous polypeptides, such as mammalian polypeptides, in filamentous fungal cells by reducing or eliminating the activity of at least three proteases found in cells that express heterologous polypeptides, and that catalyze the degradation of the heterologous polypeptides. Reducing or eliminating the activity of proteases found in the filamentous fungal cells that express heterologous polypeptides increases the stability of the expressed recombinant polypeptides, which results in an increased level of production of the heterologous polypeptides. The activity of the proteases found in the filamentous fungal cells may be reduced, for example, by modifying the genes encoding the proteases.

"Filamentous fungal cells" include cells from all filamentous forms of the subdivision Eumycota and Oomycota (as defined by Hawksworth et al., In, Ainsworth and Bisby's Dictionary of The Fungi, 8th edition, 1995, CAB International, University Press, Cambridge, UK). Filamentous fungal cells are generally characterized by a mycelial wall composed of chitin, cellulose, glucan, chitosan, mannan, and other complex polysaccharides. Vegetative growth is by hyphal elongation and carbon catabolism is obligately aerobic. In contrast, vegetative growth by yeasts such as *Saccharomyces cerevisiae* is by budding of a unicellular thallus and carbon catabolism may be fermentative.

Any filamentous fungal cell may be used in the present disclosure so long as it remains viable after being transformed with a sequence of nucleic acids and/or being modified or mutated to decrease protease activity. Preferably, the filamentous fungal cell is not adversely affected by the transduction of the necessary nucleic acid sequences, the subsequent expression of the proteins (e.g., mammalian proteins), or the resulting intermediates.

Examples of suitable filamentous fungal cells include, without limitation, cells from an *Acremonium, Aspergillus, Fusarium, Humicola, Mucor, Myceliophthora, Neurospora, Penicillium, Scytalidium, Thielavia, Tolypocladium*, or *Trichoderma* strain. In certain embodiments, the filamentous fungal cell is from a *Trichoderma* sp., *Acremonium, Aspergillus, Aureobasidium, Cryptococcus, Chrysosporium, Chrysosporium lucknowense, Filibasidium, Fusarium, Gibberella, Magnaporthe, Mucor, Myceliophthora, Myrothecium, Neocallimastix, Neurospora, Paecilomyces, Penicillium, Piromyces, Schizophyllum, Talaromyces, Thermoascus, Thielavia,* or *Tolypocladium* strain.

*Aspergillus* fungal cells of the present disclosure may include, without limitation, *Aspergillus aculeatus, Aspergillus awamori, Aspergillus clavatus, Aspergillus flavus, Aspergillus foetidus, Aspergillus fumigatus, Aspergillus japonicus, Aspergillus nidulans, Aspergillus niger, Aspergillus oryzae*, or *Aspergillus terreus*.

*Neurospora* fungal cells of the present disclosure may include, without limitation, *Neurospora crassa*.

In certain embodiments, the filamentous fungal cell is not an *Aspergillus* cell.

In certain embodiments, the filamentous fungal cell is selected from the group consisting of *Trichoderma* (*T. reesei*), *Neurospora* (*N. crassa*), *Penicillium* (*P. chrysogenum*), *Aspergillus* (*A. nidulans, A. niger* and *A. oryzae*), *Myceliophthora* (*M. thermophila*) and *Chrysosporium* (*C. lucknowense*).

In certain embodiments, the filamentous fungal cell is a *Trichoderma* fungal cell. *Trichoderma* fungal cells of the present disclosure may be derived from a wild-type *Trichoderma* strain or a mutant thereof. Examples of suitable *Trichoderma* fungal cells include, without limitation, *Trichoderma harzianum, Trichoderma koningii, Trichoderma longibrachiatum, Trichoderma reesei, Trichoderma atroviride, Trichoderma virens, Trichoderma viride*; and alternative sexual form thereof (i.e., *Hypocrea*).

General methods to disrupt genes of and cultivate filamentous fungal cells are disclosed, for example, for *Penicillium*, in Kopke et al. (2010) Application of the *Saccharomyces cerevisiae* FLP/FRT recombination system in filamentous fungi for marker recycling and construction of knockout strains devoid of heterologous genes. Appl Environ Microbiol. 76(14):4664-74. doi: 10.1128/AEM.00670-10, for *Aspergillus*, in Maruyama and Kitamoto (2011), Targeted Gene Disruption in Koji Mold *Aspergillus oryzae*, in James A. Williams (ed.), Strain Engineering: Methods and Protocols, Methods in Molecular Biology, vol. 765, DOI 10.1007/978-1-61779-197-0_27; for *Neurospora*, in Collopy et al. (2010) High-throughput construction of gene deletion cassettes for generation of *Neurospora crassa* knockout strains. Methods Mol Biol. 2010; 638:33-40. doi: 10.1007/978-1-60761-611-5_3; and for *Myceliophthora* or *Chrysosporium* PCT/NL2010/000045 and PCT/EP98/06496.

Filamentous Fungal Cell Components

Certain aspects of the present disclosure relate to filamentous fungal cells having reduced or no detectable activity of at least three proteases and having a recombinant polynucleotide encoding a heterologous polypeptide that is produced at increased levels, for example at least two-fold increased levels. Other aspects of the present disclosure relate to *Trichoderma* or closely related species fungal cells that has reduced or no detectable protease activity of at least two, three or four proteases selected from pep9, amp1, amp2 and sep1. Other aspects of the present disclosure relate to *Trichoderma* or closely related species fungal cells that has reduced or no detectable protease activity in one or more of the following proteases selected from pep9, amp1, amp2, mp1, mp2, mp3, mp4, mp5 and sep1. Other aspects of the present disclosure relate to *Trichoderma* or closely related species fungal cells that has reduced or no detectable protease activity of at least two, three or four proteases selected from proteases selected from pep1, pep2, pep3, pep4, pep5, pep8, pep11, pep12, tsp1, slp1, slp2, slp3, slp7, gap1, and gap2, where the cell further contains a recombinant polynucleotide encoding a mammalian polypeptide produced at a level of at least 2-fold higher than the production level of the polypeptide in a corresponding parental *Trichoderma* fungal cell. In certain embodiments, the filamentous fungal cells or *Trichoderma* fungal cells have reduced or no activity of at least four, at least five, at least six, at least seven, at least eight, at least nine, at least ten, at least eleven, at least twelve, or more proteases.

Reduced Expression of Proteases

The reduced activity of the at least three proteases in filamentous fungal cells or *Trichoderma* fungal cells of the present disclosure can be the result of reduced or eliminated expression of the proteases. In some embodiments, the reduced or eliminated expression of the at least three proteases is the result of a modification to the catalytic domain, the coding region, or a control sequence required for expression of the coding region of the genes encoding each of the proteases. In other embodiments, the reduced or eliminated expression of the proteases is the result of introducing, substituting, and/or removing one or more nucleotides in the genes, or a control sequence thereof required for the transcription or translation of the genes encoding each of the proteases. In some embodiments, the reduced or eliminated expression of the proteases is the result of introducing, recombining, or replacing the endogenous promoter, or part thereof, of the protease with a heterologous promoter. The "heterologous promoter" herein means an operatively linked promoter DNA sequence which is non-native for the protease. In some embodiments, the heterologous promoter reduces protease activity compared to the activity in the corresponding parental filamentous fungal cell in which the protease is expressed by its endogenous promoter. If deleting the protease affects growth, sporulation or function of the fungus, the heterologous promoter be selected in such a way that the protease is expressed, for example, during essential phase of the cell, for example sporulation, but the protease expression is reduced or eliminated during production of heterologous protein compared to the corresponding parental strain in which the protease is expressed by its endotenous promoter.

In some embodiments, the heterologous promoter is a constitutive promoter or an inducible promoter. In some embodiments, the heterologous promoter is selected from the group of flavin containing monooxygenase gene (Tre76230), the RNA polymerase gene (Tre49048), and the slp8 protease gene (Tre58698).

In some embodiments, the reduced or eliminated protease with a heterologous promoter is slp2, e.g., slp2 in *Trichoderma* fungal cell or closely related species. In some specific embodiments, the endogenous promoter of slp2, e.g. in *Trichoderma* or closely related species, is replaced with a heterologous promoter selected from the group of flavin containing monooxygenase gene (Tre76230), the RNA polymerase gene (Tre49048), and the slp8 protease gene (Tre58698). More details are given in Example 41.

In some embodiments, a filamentous fungal cell of the invention comprises at least one endogenous protease having a heterologous promoter and having reduced or no protease activity, and a recombinant polynucleotide encoding a heterologous polypeptide, wherein the cell has reduced or no protease activity in one or more of following proteases: pep9, amp1, amp2, mp1, mp2, mp3, mp4, mp5 and sep1, and, optionally one or more additional proteases selected from pep1, pep2, pep3, pep4, pep5, pep8, pep11, pep12, tsp1, slp1, slp2, slp3, slp7, gap1, and gap2.

In further embodiments, the reduced or eliminated expression of the proteases is the result of inserting into the genes encoding each of the proteases disruptive nucleic acid constructs each containing a nucleic acid fragment homologous to each of the genes that will create a duplication of the region of homology and incorporate construct DNA between the duplicated regions. In other embodiments, the reduced or eliminated expression of the proteases is the result of gene conversion of the genes encoding each of the proteases. In still other embodiments, the reduced or eliminated expression of the proteases is the result of by anti-sense polynucleotides or RNAi constructs that are specific for the each of the genes encoding each of the proteases. In one embodiment, an RNAi construct is specific for a gene encoding an aspartic protease such as a pep-type protease, a trypsin-like serine proteases such as a tsp1, a glutamic protease such as a gap-type protease, a subtilisin protease such as a sip-type protease, or a sedolisin protease such as a tpp1 or a slp7 protease. In one embodiment, an RNAi construct is specific for the gene encoding a sip-type protease. In one embodiment, an RNAi construct is specific for the gene encoding slp2, slp3, slp5 or slp6. In one embodiment, an RNAi construct is specific for two or more proteases. In one embodiment, two or more proteases are any one of the pep-type proteases, any one of the trypsin-like serine proteasess, any one of the sip-type proteases, any one of the gap-type proteases, any one of the metalloproteases and/or any one of the sedolisin proteases. In one embodiment, two or more proteases are slp2, slp3, slp5 and/or slp6. In one embodiment, RNAi construct comprises any one of nucleic acid sequences of Table 22.2.

In some embodiments, the genes encoding the proteases each contain a mutation that reduces or eliminates the corresponding protease activity. In other embodiments, the mutation reduces or eliminates the expression of each of the proteases. In further embodiments, the mutation is a knockout mutation, a truncation mutation, a point mutation, a missense mutation, a substitution mutation, a frameshift mutation, an insertion mutation, a duplication mutation, an amplification mutation, a translocation mutation, an inversion mutation that reduces or eliminates the corresponding protease activity.

In some embodiments, the mutation is a deletion of the protease encoding gene. In other embodiments, the mutation is a deletion of the portion of the protease encoding gene encoding the catalytic domain of the protease. In still other embodiments, the mutation is point mutation in the portion of the protease encoding gene encoding the catalytic domain of the protease.

Another method to disrupt protease genes of filamentous fungal cells include CRISPR-CAS system, or clustered regularly interspaced short palindromic repeats. CRISPR-Cas system is a novel technique of gene editing (silencing, enhancing or changing specific genes). By inserting a plasmid containing cas9 genes and specifically designed CRISPRs, the organism's genome can be cut at any desired location. Cas9 gene originates from the type II bacterial CRISPR system of *Streptococcus pyogenes*. Gene product, CAS9 nuclease, complexes with a specific genome targeting CRISPR guideRNA and has high site specificity of the DNA cutting activity. It has been shown recently that CAS9 can function as an RNA-guided endonuclease in various heterologous organisms (Mali et al. 2013: Rna guided human genome engineering via Cas9. Science 339:823-826; Cong et al 2013: Multiplex genome engineering using CRISPR-Cas systems. Science 339:819-823; Jiang et al 2013: RNA-guided editing of bacterial genomes using CRISPR-Cas systems. Nat Biotechnol 31:233-239; Jinek et al. 2013: RNA programmed genome editing in human cells. eLife 2:e00471; Hwang et al. 2013: Efficient genome editing in zebrafish using a CRISPR-Cas system. Nat Biotech 31:227-279. DiCarlo et al 2013: Genome engineering in *Saccharomyces cerevisiae* using CRISPR-Cas systems. NAR 41:4336-4343).

GuideRNA synthesis have been usually carried out from promoters transcribed by RNA polymerase III, most commonly used being SNR52 snoRNA promoter in yeasts and U3/U6 snoRNA promoters in plants and animals. Promoters transcribed by RNA polymerase II have been considered to be unsuitable for guideRNA synthesis because of the post-transcriptional modifications, 5'capping, 5'/3' UTR's and poly A tailing. However, it has been recently demonstrated that RNA polymerase II type promoters can be used if the guideRNA sequence is flanked with self-processing ribozyme sequences. Primary transcript then undergoes self-catalyzed cleavage and generates desired gRNA sequence (Gao and Zhao 2014: Self processing of ribozyme-flanked RNAs into guide RNA's in vitro and in vivo for CRISPR-mediated genome editing. Journal of Integrative Plant Biology e-publication ahead of print; March 2014).

Example 21 exemplifies methods to disrupt various protease encoding genes that affect and/or hinder efficient production of heterologous proteins in *T. reesei*. GuideRNA sequences as shown in Table 21.1 and their use for disrupting corresponding protease genes in *Trichoderma* cells are also part of the invention.

Combinations of Protease Genes

The filamentous fungal cells or *Trichoderma* fungal cells of the present disclosure may contain at least three, at least four, at least five, at least six, at least seven, at least eight, at least nine, at least ten, or more aspartic proteases, trypsin-like serine proteases, subtilisin proteases, glutamic proteases, and metalloproteases. In certain embodiments, the proteases are encoded by pep-type protease genes, gap-type protease genes, sip-type proteases genes, amp-type protease, sep-type protease and mp-type proteases. In some embodiments, the pep-type protease genes are selected from pep1, pep2, pep3, pep4, pep5, pep6, pep8, pep9, pep10, pep11, and pep12, pep13, pep14, pep16. In other embodiments, the gap-type protease genes are selected from gap1, and gap2. In other embodiments, the gap-type protease genes are selected from gap1, gap2, gap3 or gap4. In further embodiments, the sip-type proteases genes are selected from slp1, slp2, slp3, and slp7; or are selected from slp1, slp2, slp3, slp5, slp6, slp7, and slp8, or are selected from slp1, slp2, slp3, slp5, slp6, slp7, and slp8 and slp57433, slp35726, slp60791, or slp109276. In certain preferred embodiments, the sip-type proteases gene is slp1. In certain embodiments, the amp-type proteases are selected from amp1 and amp2. In further embodiments, the sep-type proteases are selected from sep1, sed2, sed3, and sed5. In further embodiments, the mp-type metalloproteases are selected from mp1, mp2, mp3, mp4 and mp5. In other embodiments, the proteases are encoded by genes selected from pep9, amp1, amp2, sep1, pep1, pep2, pep3, pep4, pep5, pep7, pep8, pep11, pep12, tsp1, slp1, slp2, slp3, slp5, slp6, slp7, slp8, gap1, gap2, and tpp1. In some embodiments, the filamentous fungal cell, for example, a *Trichoderma* cell has reduced or no expression levels of at least two, three or at least four protease of a first group of protease selected from pep9, amp1, amp2 and sep1, optionally in combination with a second group of protease encoding genes selected from pep1, pep2, pep3, pep4, pep5, pep8, pep11, pep12, tsp1, slp1, slp2, slp3, slp7, gap1, and gap2. In some embodiments, the filamentous fungal cell, for example, a *Trichoderma* cell has reduced or no expression levels in one or more of the following protease selected from pep9, amp1, amp2, mp1, mp2, mp3, mp4, mp5 and sep1, optionally in combination with a second group of protease encoding genes selected from pep1, pep2, pep3, pep4, pep5, pep8, pep11, pep12, tsp1, slp1, slp2, slp3, slp7, gap1, and gap2. In certain embodiments, the filamentous fungal cell, for example a *Trichoderma* cell, has reduced or no expression levels of at least three protease encoding genes selected from pep1, tsp1, and slp1. In other embodiments, the filamentous fungal cell, or *Trichoderma* cell, has reduced or no expression levels of at least three protease encoding genes selected from gap1, slp1 and pep1. In some embodiments, the filamentous fungal cell, for example, a *Trichoderma* cell has reduced or no expression levels of protease encoding genes slp2, pep1, and gap1. In some embodiments, the filamentous fungal cell, for example, a *Trichoderma* cell has reduced or no expression levels of protease encoding genes slp2, pep1, gap1, and pep4. In some embodiments, the filamentous fungal cell, for example, a *Trichoderma* cell has reduced or no expression levels of protease encoding genes slp2, pep1, gap1, pep4, and slp1. In some embodiments, the filamentous fungal cell, for example, a *Trichoderma* cell has reduced or no expression levels of protease encoding genes slp2, pep1, gap1, pep4, slp1, and slp3. In some embodiments, the filamentous fungal cell, for example, a *Trichoderma* cell has reduced or no expression levels of protease encoding genes slp2, pep1, gap1, pep4, slp1, slp3, and pep3. In some embodiments, the filamentous fungal cell, for example, a *Trichoderma* cell has reduced or no expression levels of protease encoding genes slp2, pep1, gap1, pep4, slp1, slp3, pep3, and pep2.

In some embodiments, the filamentous fungal cell, for example, a *Trichoderma* cell has reduced or no expression levels of protease encoding genes slp2, pep1, gap1, pep4, slp1, slp3, pep3, pep2, and pep5. In some embodiments, the filamentous fungal cell, for example, a *Trichoderma* cell has reduced or no expression levels of protease encoding genes slp2, pep1, gap1, pep4, slp1, slp3, pep3, pep2, pep5, and tsp1. In some embodiments, the filamentous fungal cell, for example, a *Trichoderma* cell has reduced or no expression levels of protease encoding genes slp2, pep1, gap1, pep4, slp1, slp3, pep3, pep2, pep5, tsp1, and slp7. In some embodiments, the cell, for example a *Trichoderma* cell, has reduced or no protease activity in at least twelve proteases, each of the genes encoding the twelve proteases comprises a mutation that reduces or eliminates the corresponding protease activity, and the twelve proteases are pep1, slp1, gap1, gap2, pep4, pep3, pep5, pep2, sep1, slp8, amp2, slp7. In other embodiments, the cell, for example a *Trichoderma* cell has either (i) reduced or no protease activity in at least thirteen proteases, each of the genes encoding the thirteen proteases comprises a mutation that reduces or eliminates the corresponding protease activity, and the thirteen proteases are either pep1, tsp1, slp1, gap1, gap2, pep4, pep3, pep5, pep2, sep1, slp8, amp2, pep9;

pep1, tsp1, slp1, gap1, gap2, pep4, pep3, pep5, pep2, sep1, slp8, amp2, slp7; or pep1, tsp1, slp1, gap1, gap2, pep4, pep3, pep5, pep2, sep1, slp8, amp2, slp3;

(ii) the cell has reduced or no protease activity in at least fourteen proteases, each of the genes encoding the fourteen proteases comprises a mutation that reduces or eliminates the corresponding protease activity, and the fourteen proteases are pep1 tsp1 slp1 gap1 gap2 pep4 pep3 pep5 pep2 sep1 slp8 amp2 pep9 slp2;

(iii) the cell has reduced or no protease activity in at least fifteen proteases, each of the genes encoding the fifteen proteases comprises a mutation that reduces or eliminates the corresponding protease activity, and the fifteen proteases are either pep1 tsp1 slp1 gap1 gap2 pep4 pep3 pep5 pep2 sep1 slp8 amp2 pep9 slp2 mp1; or, pep1 tsp1 slp1 gap1 gap2 pep4 pep3 pep5 pep2 sep1 slp8 amp2 pep9 slp2 mp5.

In other embodiments, the filamentous fungal cell of the invention, for example a *Trichoderma* cell, has reduced or no protease activity in at least sixteen, at least seventeen, at least eighteen, at least nineteen, or at least twenty or more proteases, with 13, 14, or 15 mutations in the above recited proteases, and further comprising one or more additional mutations, each additional mutation reduces or eliminates a corresponding additional protease activity, said additional protease being selected from the group consisting of an aspartic protease pep6, pep1 0, pep13, pep14, or pep16;

slp like protease slp57433, slp35726, slp60791, or slp109276;
gap like protease gap3 or gap4;
sedolisin like protease sed2, sed3, or sed5;
Group A protease selected from the group of protease65735, protease77577, protease81087, protease56920, protease122083, protease79485, protease120998, or protease61127;
Group B protease selected from the group of protease21659, protease58387, protease75159, protease56853, or protease64193;
Group C protease selected from the group of protease82452, protease80762, protease21668, protease81115, protease82141, protease23475;
Group D protease selected from the group of protease121890, protease22718, protease47127, protease61912, protease80843, protease66608, protease72612, protease40199; or
Group E protease selected from the group of protease22210, protease111694, protease82577.

In some embodiments, the filamentous fungal cell, for example, a *Trichoderma* cell has reduced or no expression levels of protease encoding genes slp2, pep1, gap1, pep4, slp1, slp3, pep3, pep2, pep5, tsp1, slp7, and slp8. In some embodiments, the filamentous fungal cell, for example, a *Trichoderma* cell has reduced or no expression levels of protease encoding genes slp2, pep1, gap1, pep4, slp1, slp3, pep3, pep2, pep5, tsp1, slp7, slp8, and gap2.

In certain embodiments, the filamentous fungal cell has at least three, at least four, at least five, at least six, at least seven, at least eight, at least nine, at least ten, or more proteases with reduced protease activity, wherein the corresponding proteases with wild type activity each have an amino acid sequence that is at least 70%, at least 75%, at least 80%, at least 85%, at least 90%, at least 95%, at least 96%, at least 97%, at least 98%, at least 99%, or 100% identical to the amino acid sequences of SEQ ID NOs: 1-16; 17-36; 37-57; 58-65; 66-81; 82-97; 98-117; 118-128; 129-144; 166-181; 182-185; 491-588, SEQ ID NOs 750-805 or SEQ ID NOs 875-923. In embodiments where the filamentous fungal cell is a *Trichoderma* fungal cell with reduced protease activity in one or more proteases, wherein the corresponding proteases with wild type activity each have an amino acid sequence that is at least 70%, at least 75%, at least 80%, at least 85%, at least 90%, at least 95%, at least 96%, at least 97%, at least 98%, at least 99%, or 100% identical to the amino acid sequences of SEQ ID NOs: 1, 17, 37, 58, 66, 82, 98, 118, 129, 166, 182, 507, 522, 530, 750, 759, 775, SEQ ID NO:786, or SEQ ID NOs 875-923.

Heterologous Polypeptides

The filamentous fungal cells or *Trichoderma* fungal cells of the present disclosure contain a recombinant polynucleotide encoding a heterologous polypeptide. In certain embodiments, the heterologous polypeptide is a mammalian polypeptide. In other embodiments, heterologous polypeptide is a non-mammalian polypeptide.

In embodiments where the filamentous fungal cell contains a recombinant polynucleotide encoding a mammalian polypeptide, the mammalian polypeptide can be a non-glycosylated mammalian polypeptide, a glycosylated mammalian polypeptide, or combinations thereof, including, without limitation, an immunoglobulin, an antibody, a growth factor, and an interferon. In some embodiments, the mammalian polypeptide is an immunoglobulin or antibody. In embodiments where the filamentous fungal cell contains a recombinant polynucleotide encoding an immunoglobulin or antibody, the filamentous fungal cell, for example, a *Trichoderma* fungal cell may have reduced or no expression of at least two, three or at least four protease encoding genes selected from pep9, amp1, amp2 and sep1, optionally in combination with at least three or four proteases selected from pep1, pep3, pep4, pep8, pep11, pep12, tsp1, slp1, slp2, slp7, gap1, and gap2. In some embodiments where the filamentous fungal cell contains a recombinant polynucleotide encoding an immunoglobulin or antibody, for example, a *Trichoderma* cell, said cell has reduced or no expression levels in one or more of the following protease selected from pep9, amp1, amp2, mp1, mp2, mp3, mp4, mp5 and sep1, optionally in combination with one or more additional proteases encoding genes selected from pep1, pep2, pep3, pep4, pep5, pep8, pep11, pep12, tsp1, slp1, slp2, slp3, slp7, gap1, and gap2. In certain preferred embodiments, the cell, for example a *Trichoderma* fungal cell, contains a recombinant polynucleotide encoding an immunoglobulin or antibody and has reduced or no expression of the protease encoding genes pep1, tsp1, slp1, and gap1. In other embodiments, the cell contains a recombinant polynucleotide encoding an immunoglobulin or antibody and has reduced expression of the protease encoding genes pep1, tsp1, slp1, gap1, and pep4. In other embodiments, the cell contains a recombinant polynucleotide encoding an immunoglobulin or antibody and has reduced expression of the protease encoding genes slp1, slp2, and slp3. In other embodiments, the cell contains a recombinant polynucleotide encoding an immunoglobulin or antibody and has reduced expression of the protease encoding genes slp1, slp2, slp3, and tsp1. In other embodiments, the cell contains a recombinant polynucleotide encoding an immunoglobulin or antibody and has reduced expression of the protease encoding genes slp1, slp2, slp3, tsp1, and pep1. In other embodiments, the cell contains a recombinant polynucleotide encoding an immunoglobulin or antibody and has reduced expression of the protease encoding genes slp1, slp2, slp3, tsp1, pep1, and gap1. In other embodiments, the cell contains a recombinant polynucleotide encoding an immunoglobulin or antibody and has reduced expression of the protease encoding genes slp1, slp2, slp3, tsp1, pep1, gap1, and pep4. In other embodiments, the cell contains a recombinant polynucleotide encoding an immunoglobulin or antibody and has reduced expression of the protease encoding genes slp1, slp2, slp3, tsp1, pep1, gap1, pep4, and pep3. In other embodiments, the cell contains a recombinant polynucleotide encoding an immunoglobulin or antibody and has reduced expression of the protease encoding genes slp1, slp2, slp3, tsp1, pep1, gap1, pep4, pep3, and pep2. In other embodiments, the cell contains a recombinant polynucleotide encoding an immunoglobulin or antibody and has reduced expression of the protease encoding genes slp1, slp2, slp3, tsp1, pep1, gap1, pep4, pep3, pep2, and pep5. In some embodiments, the cell, for example a *Trichoderma* cell, contains a recombinant polynucleotide encoding an immunoglobulin or antibody and has reduced or no protease activity in at least twelve proteases, each of the genes encoding the twelve proteases comprises a mutation that reduces or eliminates the corresponding protease activity, and the twelve proteases are pep1, slp1, gap1, gap2, pep4, pep3, pep5, pep2, sep1, slp8, amp2, slp7. In other embodiments, the cell, for example a *Trichoderma* cell, contains a recombinant polynucleotide encoding an immunoglobulin or antibody and has either
  (i) reduced or no protease activity in at least thirteen proteases, each of the genes encoding the thirteen proteases comprises a mutation that reduces or eliminates the corresponding protease activity, and the thirteen proteases are either pep1, tsp1, slp1, gap1, gap2, pep4, pep3, pep5, pep2, sep1, slp8, amp2, pep9;

pep1, tsp1, slp1, gap1, gap2, pep4, pep3, pep5, pep2, sep1, slp8, amp2, slp7;

pep1, tsp1, slp1, gap1, gap2, pep4, pep3, pep5, pep2, sep1, slp8, amp2, slp3;

(ii) reduced or no protease activity in at least fourteen proteases, each of the genes encoding the fourteen proteases comprises a mutation that reduces or eliminates the corresponding protease activity, and the fourteen proteases are pep1 tsp1 slp1 gap1 gap2 pep4 pep3 pep5 pep2 sep1 slp8 amp2 pep9 slp2; or, (iii) reduced or no protease activity in at least fifteen proteases, each of the genes encoding the fifteen proteases comprises a mutation that reduces or eliminates the corresponding protease activity, and the fifteen proteases are either pep1 tsp1 slp1 gap1 gap2 pep4 pep3 pep5 pep2 sep1 slp8 amp2 pep9 slp2 mp1; or, pep1 tsp1 slp1 gap1 gap2 pep4 pep3 pep5 pep2 sep1 slp8 amp2 pep9 slp2 mp5.

In other embodiments, the filamentous fungal cell, for example a *Trichoderma* cell, contains a recombinant polynucleotide encoding an immunoglobulin or antibody and has reduced or no protease activity in at least sixteen, at least seventeen, at least eighteen, at least nineteen, or at least twenty or more proteases, with 13, 14 or 15 mutations in the above recited proteases, and further comprising one or more additional mutation, each additional mutation reduces or eliminates the corresponding additional protease activity, and said at least additional protease being selected from the group consisting of an aspartic protease pep6, pep10, pep13, pep14, or pep16;

slp like protease slp57433, slp35726, slp60791, or slp109276;

gap like protease gap3 or gap4;

sedolisin like protease sed2, sed3, or sed5;

Group A protease selected from the group of protease65735, protease77577, protease81087, protease56920, protease122083, protease79485, protease120998, or protease61127;

Group B protease selected from the group of protease21659, protease58387, protease75159, protease56853, or protease64193;

Group C protease selected from the group of protease82452, protease80762, protease21668, protease81115, protease82141, protease23475;

Group D protease selected from the group of protease121890, protease22718, protease47127, protease61912, protease80843, protease66608, protease72612, protease40199; or Group E protease selected from the group of protease22210, protease111694, protease82577.

In other embodiments, the filamentous fungal cell contains a recombinant polynucleotide encoding a growth factor, interferon, cytokine, or interleukin. In embodiments where the filamentous fungal cell, for example a *Trichoderma* fungal cell contains a recombinant polynucleotide encoding a growth factor, interferon, cytokine, human serum albumin, or interleukin, the filamentous fungal cell may have reduced or no expression of at least two, three or four proteases selected from pep9, amp1, amp2 and sep1, optionally in combination with at least three or four proteases selected from pep1, pep3, pep4, pep8, pep11, pep12, tsp1, slp1, slp2, slp7, gap1, and gap2 or at least three or at least four protease encoding genes selected from pep1, pep2, pep3, pep4, pep5, pep8, gap1, gap2, slp1, slp2, slp7, and tsp1.

In some embodiments where the filamentous fungal cell contains a recombinant polynucleotide encoding a growth factor, interferon, cytokine, human serum albumin, or interleukin, for example, a *Trichoderma* cell, said cell has reduced or no expression levels in one or more of the following protease selected from pep9, amp1, amp2, mp1, mp2, mp3, mp4, mp5 and sep1, optionally in combination with a second group of protease encoding genes selected from pep1, pep2, pep3, pep4, pep5, pep8, pep11, pep12, tsp1, slp1, slp2, slp3, slp7, gap1, and gap2. In certain embodiments, the cell contains a recombinant polynucleotide encoding a growth factor, interferon, cytokine, human serum albumin, or interleukin and has reduced expression of the protease encoding genes pep1, tsp1, slp1, gap1, and gap2.

In certain embodiments, the cell contains a recombinant polynucleotide encoding a growth factor, interferon, cytokine, human serum albumin, or interleukin and has reduced expression of the protease encoding genes slp1, slp2, pep1, gap1, pep4, slp7, pep2, pep3, pep5, tsp1, and gap2. In other embodiments, the cell, for example a *Trichoderma* fungal cell, contains a recombinant polynucleotide encoding a growth factor, interferon, cytokine, human serum albumin, or interleukin and has reduced expression of the protease encoding genes pep1, tsp1, slp1, gap1, gap2, and pep4. In a further embodiment, the cell contains a recombinant polynucleotide encoding a growth factor, and has reduced expression of a pep-type protease genes are selected from pep1, pep2, pep3, pep4, and pep5.

In certain preferred embodiments, the growth factor is IGF-1 or the interferon is interferon-α 2b. In certain embodiments, the cell contains a recombinant polynucleotide encoding a growth factor, interferon, cytokine, human serum albumin, or interleukin and has reduced expression of the protease encoding genes pep1, gap1, and pep4. In certain embodiments, the cell contains a recombinant polynucleotide encoding a growth factor, interferon, cytokine, human serum albumin, or interleukin and has reduced expression of the protease encoding genes pep1, gap1, pep4, and slp7. In certain embodiments, the cell contains a recombinant polynucleotide encoding a growth factor, interferon, cytokine, human serum albumin, or interleukin and has reduced expression of the protease encoding genes pep1, gap1, pep4, slp7, and slp2. In certain embodiments, the cell contains a recombinant polynucleotide encoding a growth factor, interferon, cytokine, human serum albumin, or interleukin and has reduced expression of the protease encoding genes pep1, gap1, pep4, slp7, slp2, and pep2.

In certain embodiments, the cell contains a recombinant polynucleotide encoding a growth factor, interferon, cytokine, human serum albumin, or interleukin and has reduced expression of the protease encoding genes pep1, gap1, pep4, slp7, slp2, pep2, and pep3. In certain embodiments, the cell contains a recombinant polynucleotide encoding a growth factor, interferon, cytokine, human serum albumin, or interleukin and has reduced expression of the protease encoding genes pep1, gap1, pep4, slp7, slp2, pep2, pep3, and pep5. In certain embodiments, the cell contains a recombinant polynucleotide encoding a growth factor, interferon, cytokine, human serum albumin, or interleukin and has reduced expression of the protease encoding genes pep1, gap1, pep4, slp7, slp2, pep2, pep3, pep5, and slp1. In certain embodiments, the cell contains a recombinant polynucleotide encoding a growth factor, interferon, cytokine, human serum albumin, or interleukin and has reduced expression of the protease encoding genes pep1, gap1, pep4, slp7, slp2, pep2, pep3, pep5, slp1, and tsp1.

In some embodiments, the cell, for example a *Trichoderma* cell, contains a recombinant polynucleotide encoding a growth factor, interferon, cytokine, human serum albumin, or interleukin and has reduced or no protease activity in at least twelve proteases, each of the genes encoding the twelve proteases comprises a mutation that reduces or eliminates the corresponding protease activity, and the twelve proteases are pep1, slp1, gap1, gap2, pep4, pep3, pep5, pep2, sep1, slp8, amp2, slp7. In other embodiments, the cell, for example a *Trichoderma* cell, contains a recombinant polynucleotide encoding a growth factor, interferon, cytokine, human serum albumin, or interleukin and has either (i) reduced or no protease activity in at least thirteen proteases, each of the genes encoding the thirteen proteases comprises a mutation that reduces or eliminates the corresponding protease activity, and the thirteen proteases are either pep1, tsp1, slp1, gap1, gap2, pep4, pep3, pep5, pep2, sep1, slp8, amp2, pep9;

pep1, tsp1, slp1, gap1, gap2, pep4, pep3, pep5, pep2, sep1, slp8, amp2, slp7;

pep1, tsp1, slp1, gap1, gap2, pep4, pep3, pep5, pep2, sep1, slp8, amp2, slp3;

(ii) reduced or no protease activity in at least fourteen proteases, each of the genes encoding the fourteen proteases comprises a mutation that reduces or eliminates the corresponding protease activity, and the fourteen proteases are pep1 tsp1 slp1 gap1 gap2 pep4 pep3 pep5 pep2 sep1 slp8 amp2 pep9 slp2; or, (iii) reduced or no protease activity in at least fifteen proteases, each of the genes encoding the fifteen proteases comprises a mutation that reduces or eliminates the corresponding protease activity, and the fifteen proteases are either pep1 tsp1 slp1 gap1 gap2 pep4 pep3 pep5 pep2 sep1 slp8 amp2 pep9 slp2 mp1; or, pep1 tsp1 slp1 gap1 gap2 pep4 pep3 pep5 pep2 sep1 slp8 amp2 pep9 slp2 mp5.

In other embodiments, the filamentous fungal cell, for example a *Trichoderma* cell, contains a recombinant polynucleotide encoding growth factor, interferon, cytokine, human serum albumin, or interleukin and has reduced or no protease activity in at least sixteen, at least seventeen, at least eighteen, at least nineteen, or at least twenty or more proteases, with mutations in the above recited 13, 14 or 15 proteases, and further comprising one or more additional mutation, each additional mutation reduces or eliminates the corresponding additional protease activity, and said at least additional protease being selected from the group consisting of an aspartic protease pep6, pep1 0, pep13, pep14, or pep16;

slp like protease slp57433, slp35726, slp60791, or slp109276;

gap like protease gap3 or gap4;

sedolisin like protease sed2, sed3, or sed5;

Group A protease selected from the group of protease65735, protease77577, protease81087, protease56920, protease122083, protease79485, protease120998, or protease61127;

Group B protease selected from the group of protease21659, protease58387, protease75159, protease56853, or protease64193;

Group C protease selected from the group of protease82452, protease80762, protease21668, protease81115, protease82141, protease23475;

Group D protease selected from the group of protease121890, protease22718, protease47127, protease61912, protease80843, protease66608, protease72612, protease40199; or Group E protease selected from the group of protease22210, protease111694, protease82577.

In certain embodiments, the mammalian polypeptide is produced at a level that is at least 3-fold, at least 4-fold, at least 5-fold, at least 6-fold, at least 7-fold, at least 8-fold, at least 9-fold, at least 10-fold, at least 15-fold, at least 20-fold, at least 25-fold, at least 30-fold, at least 40-fold, at least 50-fold, at least 60-fold, at least 70-fold, at least 75-fold, at least 80-fold, at least 90-fold, at least 100-fold, or a greater fold higher than the production level of the polypeptide in a corresponding parental filamentous fungal cell without the reduced protease activity. In other embodiments, the mammalian polypeptide is produced in a full length version at a level higher than the production level of the full-length version of the polypeptide in a corresponding parental filamentous fungal cell.

In embodiments where the filamentous fungal cell contains a recombinant polynucleotide encoding a non-mammalian polypeptide, the non-mammalian polypeptide may be an aminopeptidase, amylase, carbohydrase, carboxypeptidase, catalase, cellulase, chitinase, cutinase, deoxyribonuclease, esterase, alpha-galactosidase, beta-galactosidase, glucoamylase, alpha-glucosidase, beta-glucosidase, invertase, laccase, lipase, mutanase, oxidase, pectinolytic enzyme, peroxidase, phospholipase, phytase, polyphenoloxidase, proteolytic enzyme, ribonuclease, transglutaminase or xylanase. In embodiments where the filamentous fungal cell contains a recombinant polynucleotide encoding a non-mammalian polypeptide, the filamentous fungal cell may have reduced or no detectable expression of at least two, three or four proteases selected from pep9, amp1, amp2 mp1, mp2, mp3, mp4, mp5 and sep1, optionally in combination with three, at least four, at least five, or at least six protease encoding genes selected from pep1, pep2, pep2, pep4, pep5, pep8, pep11, pep12, tsp1, slp1, slp2, slp3, slp7, gap1, and gap2. In certain embodiments, the non-mammalian polypeptide is produced at a level that is at least 3-fold, at least 4-fold, at least 5-fold, at least 6-fold, at least 7-fold, at least 8-fold, at least 9-fold, at least 10-fold, at least 15-fold, at least 20-fold, at least 25-fold, at least 30-fold, at least 40-fold, at least 50-fold, at least 60-fold, at least 70-fold, at least 75-fold, at least 80-fold, at least 90-fold, at least 100-fold, or a greater fold higher than the production level of the polypeptide in a corresponding parental filamentous fungal cell. In other embodiments, the non-mammalian polypeptide is produced in a full length version at a level higher than the production level of the full-length version of the polypeptide in a corresponding parental filamentous fungal cell.

Reduced Activity of Additional Proteases

In some embodiments, the filamentous fungal cells or *Trichoderma* fungal cells of the present disclosure also have reduced activity of one or more additional proteases. In certain embodiments, the expression level of the one or more additional proteases is reduced. In certain preferred embodiments, genes encoding the one or more additional proteases each comprise a mutation that reduces the corresponding protease activity. The one or more additional protease encoding genes may be pep7, tpp1, gap2, slp3, slp5, slp6, slp7, slp8, or a gene encoding protease selected from the group consisting of
- an aspartic protease pep6, pep1 0, pep13, pep14, or pep16;
- slp like protease slp57433, slp35726, slp60791, or slp109276;
- gap like protease gap3 or gap4;
- sedolisin like protease sed2, sed3, or sed5;
- Group A protease selected from the group of protease65735, protease77577, protease81087, protease56920, protease122083, protease79485, protease120998, or protease61127;
- Group B protease selected from the group of protease21659, protease58387, protease75159, protease56853, or protease64193;
- Group C protease selected from the group of protease82452, protease80762, protease21668, protease81115, protease82141, protease23475;
- Group D protease selected from the group of protease121890, protease22718, protease47127, protease61912, protease80843, protease66608, protease72612, protease40199; or
- Group E protease selected from the group of protease22210, protease111694, protease82577.

In certain embodiments, when the filamentous fungal cells is an *Aspergillus* cell, the total protease activity is reduced to 50% or less of the total protease activity in the corresponding parental *Aspergillus* cell in which the proteases do not have reduced activity.

In certain embodiments, total protease activity is reduced in the cell of the present disclosure, for example a *Trichoderma* cell, to 49% or less, 31% or less, 13% or less, 10% or less, 6.3% or less, or 5.5% or less, of the total protease activity in the corresponding parental filamentous fungal cell in which the proteases do not have reduced activity.

Additional Recombinant Modifications

In certain embodiments, the filamentous fungal cells or *Trichoderma* fungal cells of the present disclosure also have reduced activity of a dolichyl-P-Man:Man(5)GlcNAc(2)-PP-dolichyl mannosyltransferase. Dolichyl-P-Man:Man(5)GlcNAc(2)-PP-dolichyl mannosyltransferase (EC 2.4.1.130) transfers an alpha-D-mannosyl residue from dolichyl-phosphate D-mannose into a membrane lipid-linked oligosaccharide. Typically, the dolichyl-P-Man:Man(5)GlcNAc(2)-PP-dolichyl mannosyltransferase enzyme is encoded by an alg3 gene. Thus, in certain embodiments, the filamentous fungal cell has reduced activity of ALG3, which is the activity encoded by the alg3 gene. In some embodiments, the alg3 gene contains a mutation that reduces the corresponding ALG3 activity. In certain embodiments, the alg3 gene is deleted from the filamentous fungal cell.

In other embodiments, the filamentous fungal cells or *Trichoderma* fungal cells of the present disclosure further contain a polynucleotide encoding an α-1,2-mannosidase. The polynucleotide encoding the α-1,2-mannosidase may be endogenous in the host cell, or it may be heterologous to the host cell. These polynucleotides are especially useful for a filamentous fungal cell expressing high-mannose glycans transferred from the Golgi to the ER without effective exo-α-2-mannosidase cleavage. The α-1,2-mannosidase may be a mannosidase I type enzyme belonging to the glycoside hydrolase family 47 (cazy.org/GH47_all.html). In certain embodiments the α-1,2-mannosidase is an enzyme listed at cazy.org/GH47_characterized.html. In particular, the α-1,2-mannosidase may be an ER-type enzyme that cleaves glycoproteins such as enzymes in the subfamily of ER α-mannosidase I EC 3.2.1.113 enzymes. Examples of such enzymes include human α-2-mannosidase 1B (AAC26169), a combination of mammalian ER mannosidases, or a filamentous fungal enzyme such as α-1,2-mannosidase (MDS1) (*T. reesei* AAF34579; Maras M et al J Biotech. 77, 2000, 255). For ER/Golgi expression the catalytic domain of the mannosidase is typically fused with a targeting peptide, such as HDEL, KDEL, or part of an ER or early Golgi protein, or expressed with an endogenous ER targeting structures of an animal or plant mannosidase I enzyme, see, for example, Callewaert et al. 2001 Use of HDEL-tagged *Trichoderma reesei* mannosyl oligosaccharide 1,2-α-D-mannosidase for N-glycan engineering in *Pichia pastoris*. FEBS Lett 503: 173-178.

In further embodiments, the filamentous fungal cells or *Trichoderma* fungal cells of the present disclosure also contain an N-acetylglucosaminyltransferase I catalytic domain and an N-acetylglucosaminyltransferase II catalytic domain. Such catalytic domains are useful for expressing complex N-glycans in non-mammalian cells. N-acetylglucosaminyltransferase I (GlcNAc-TI; GnTI; EC 2.4.1.101) catalyzes the reaction UDP-N-acetyl-D-glucosamine+3-(alpha-D-mannosyl)-beta-D-mannosyl-R<=>UDP+3-(2-(N-acetyl-beta-D-glucosaminyl)-alpha-D-mannosyl)-beta-D-mannosyl-R, where R represents the remainder of the N-linked oligosaccharide in the glycan acceptor. An N-acetylglucosaminyltransferase I catalytic domain is any portion of an N-acetylglucosaminyltransferase I enzyme that is capable of catalyzing this reaction. N-acetylglucosaminyltransferase II (GlcNAc-TII; GnTII; EC 2.4.1.143) catalyzes the reaction UDP-N-acetyl-D-glucosamine+6-(alpha-D-mannosyl)-beta-D-mannosyl-R<=>UDP+6-(2-(N-acetyl-beta-D-glucosaminyl)-alpha-D-mannosyl)-beta-D-mannosyl-R, where R represents the remainder of the N-linked oligosaccharide in the glycan acceptor. An N-acetylglucosaminyltransferase II catalytic domain is any portion of an N-acetylglucosaminyltransferase II enzyme that is capable of catalyzing this reaction. Examples of suitable N-acetylglucosaminyltransferase I catalytic domains and an N-acetylglucosaminyltransferase II catalytic domains can be found in International Patent Publication WO2012/069593. The N-acetylglucosaminyltransferase I catalytic domain and N-acetylglucosaminyltransferase II catalytic domain can be encoded by a single polynucleotide. In certain embodiments, the single polynucleotide encodes a fusion protein containing the N-acetylglucosaminyltransferase I catalytic domain and the N-acetylglucosaminyltransferase II catalytic domain. Alternatively, the N-acetylglucosaminyltransferase I catalytic domain can be encoded by a first polynucleotide and the N-acetylglucosaminyltransferase II catalytic domain can be encoded by a second polynucleotide.

In embodiments where, the filamentous fungal cell or *Trichoderma* fungal cell contains an N-acetylglucosaminyltransferase I catalytic domain and an N-acetylglucosaminyltransferase II catalytic domain, the cell can also contain a polynucleotide encoding a mannosidase II. Mannosidase II enzymes are capable of cleaving Man5 structures of GlcNAcMan5 to generate GlcNAcMan3, and if combined with action of a catalytic domain of GnTII, to generate G0; and further, with action of a catalytic domain of a galactosyltransferase, to generate G1 and G2. In certain embodiments mannosidase II-type enzymes belong to glycoside hydrolase family 38 (cazy.org/GH38_all.html). Examples of such enzymes include human enzyme AAC50302, *D. melanogaster* enzyme (Van den Eisen J. M. et al (2001) EMBO J.

20: 3008-3017), those with the 3D structure according to PDB-reference 1HTY, and others referenced with the catalytic domain in PDB. For ER/Golgi expression, the catalytic domain of the mannosidase is typically fused with an N-terminal targeting peptide, for example using targeting peptides listed in the International Patent Publication No. WO2012/069593 or of SEQ ID NOs 589-594. After transformation with the catalytic domain of a mannosidase II-type mannosidase, a strain effectively producing GlcNAc2Man3, GlcNAc1Man3 or G0 is selected.

In certain embodiments that may be combined with the preceding embodiments, the filamentous fungal cell further contains a polynucleotide encoding a UDP-GlcNAc transporter.

In certain embodiments that may be combined with the preceding embodiments, the filamentous fungal cell further contains a polynucleotide encoding a β-1,4-galactosyltransferase. Generally, ρ-1,4-galactosyltransferases belong to the CAZy glycosyltransferase family 7 (cazy.org/GT7_all.html). Examples of useful β4GalT enzymes include β4GalT1, e.g. bovine *Bos taurus* enzyme AAA30534.1 (Shaper N. L. et al Proc. Natl. Acad. Sci. U.S.A. 83 (6), 1573-1577 (1986)), human enzyme (Guo S. et al. Glycobiology 2001, 11:813-20), and *Mus musculus* enzyme AAA37297 (Shaper, N. L. et al. 1998 J. Biol. Chem. 263 (21), 10420-10428). In certain embodiments of the invention where the filamentous fungal cell contains a polynucleotide encoding a galactosyltransferase, the filamentous fungal cell also contains a polynucleotide encoding a UDP-Gal 4 epimerase and/or UDP-Gal transporter. In certain embodiments of the invention where the filamentous fungal cell contains a polynucleotide encoding a galactosyltransferase, lactose may be used as the carbon source instead of glucose when culturing the host cell. The culture medium may be between pH 4.5 and 7.0 or between 5.0 and 6.5. In certain embodiments of the invention where the filamentous fungal cell contains a polynucleotide encoding a galactosyltransferase and, optionally, a polynucleotide encoding a UDP-Gal 4 epimerase and/or UDP-Gal transporter, a divalent cation such as Mn2+, Ca2+ or Mg2+ may be added to the cell culture medium.

In certain embodiments that may be combined with the preceding embodiments, the level of activity of alpha-1,6-mannosyltransferase in the host cell is reduced compared to the level of activity in a wild-type host cell. In certain embodiments, the filamentous fungal has a reduced level of expression of an och1 gene compared to the level of expression in a wild-type filamentous fungal cell.

Another aspect includes methods of producing a Man3GlcNAc2 N-glycan [i.e. Manα3(Manα6)Manβ4GlcNAcβ4GlcNAc] in a filamentous fungal cell including the steps of providing a filamentous fungal cell with a recombinant polynucleotide encoding a heterologous polypeptide and a reduced level of activity of an alg3 mannosyltransferase compared to the level of activity in a wild-type filamentous fungal cell and culturing the filamentous fungal cell to produce a Man3GlcNAc2 glycan, where the Man3GlcNAc2 glycan constitute at least 10%, at least 20%, at least 30%, at least 40%, at least 50%, at least 60%, at least 70%, at least 80%, at least 90%, or 100% (mol %) of the neutral N-glycans secreted by the filamentous fungal cell. In certain embodiment, Man3GlcNAc2 N-glycan represents at least 10%, at least 20%, at least 30%, at least 40%, at least 50%, at least 60%, at least 70%, at least 80%, at least 90%, or 100% (mol %) of the total N-glycans of the heterologous polypeptide.

Another aspect includes methods of producing a complex N-glycan (i.e an N-glycan comprising a terminal GlcNAc2Man3 structure), for example GlcNAc2Man3GlcNAc2 {i.e. G0, i.e. GlcNAcβ2Manα3(GlcNAcβ2Manα6)Manβ4GlcNAcβ4GlcNAc} glycan in a filamentous fungal cell including the steps of providing a filamentous fungal cell with a recombinant polynucleotide encoding a heterologous polypeptide, a reduced level of activity of an alg3 mannosyltransferase compared to the level of activity in a wild-type filamentous fungal cell and comprising further a polynucleotide encoding an N-acetylglucosaminyltransferase I catalytic domain and a polynucleotide encoding an N-acetylglucosaminyltransferase II catalytic domain and culturing the filamentous fungal cell to produce the complex N-glycan, for example GlcNAc2Man3GlcNAc2 glycan, where the GlcNAc2Man3GlcNAc2 glycan constitutes at least 5%, at least 10%, at least 20%, at least 30%, at least 40%, at least 50%, at least 60%, at least 70%, at least 80%, at least 90%, or 100% (mol %) of the neutral N-glycans secreted by the filamentous fungal cell. In certain embodiments, the complex N-glycan, for example GlcNAc2Man3GlcNAc2 glycan, represents at least 5%, at least 10%, at least 20%, at least 30%, at least 40%, at least 50%, at least 60%, at least 70%, at least 80%, at least 90%, or 100% (mol %) of the total N-glycans of the polypeptide. In certain embodiments, said complex N-glycans are GlcNAcMan3 and/or GlcNAc2Man3.

Another aspect includes methods of producing a G1 or G2 N-glycan or mixture thereof, for example GalGlcNAc2Man3GlcNAc2 {i.e. G1, i.e. Galβ4GlcNAcβ2Manα3(GlcNAcβ2Manα6)Manβ4GlcNAcβ4GlcNAc} or GlcNAcβ2Manα3(Galβ4GlcNAcβ2Manα6)Manβ4GlcNAcβ4GlcNAc} and/or Gal2GlcNAc2Man3GlcNAc2 {i.e. G2, i.e. Galβ4GlcNAcβ2Manα3(Galβ4GlcNAcβ2Manα6)Manβ4GlcNAcβ4GlcNAc} glycan in a filamentous fungal cell including the steps of providing a filamentous fungal cell with a recombinant polynucleotide encoding a heterologous polypeptide and a reduced level of activity of an alg3 mannosyltransferase compared to the level of activity in a wild-type filamentous fungal cell and comprising further a polynucleotide encoding an N-acetylglucosaminyltransferase I catalytic domain, a polynucleotide encoding an N-acetylglucosaminyltransferase II catalytic domain, and a polynucleotide encoding a GalT catalytic domain and culturing the filamentous fungal cell to produce the G1 or G2 N-glycan or mixture thereof, where G1 glycan constitutes at least 5%, at least 10%, at least 20%, at least 30%, at least 40%, at least 50%, at least 60%, at least 70%, at least 80%, at least 90%, or 100% (mol %) of the neutral N-glycans secreted by the filamentous fungal cell, or where the G2 glycan constitutes at least 5%, at least 10%, at least 20%, at least 30%, at least 40%, at least 50%, at least 60%, at least 70%, at least 80%, at least 90%, or 100% (mol %) of the neutral N-glycans secreted by the filamentous fungal cell. In certain embodiment, G1 glycan constitutes at least 10%, at least 20%, at least 30%, at least 40%, at least 50%, at least 60%, at least 70%, at least 80%, at least 90%, or 100% (mol %) of the total N-glycans of the polypeptide. In certain embodiment, G2 glycan constitutes at least 10%, at least 20%, at least 30%, at least 40%, at least 50%, at least 60%, at least 70%, at least 80%, at least 90%, or 100% (mol %) of the total N-glycans of the polypeptide.

In certain embodiments, the method of producing a complex N-glycan will generate a mixture of different glycans. The complex N-glycan or Man3GlcNAc2 may constitute at least 5%, at least 10%, at least 20%, at least 30%, at least 40%, at least 50%, at least 60%, at least 70%, at least 80%), or at least 90% or more of such a glycan mixture. In certain embodiments, at least 5%, at least 10%, at least 20%, at least 30%, at least 40%, at least 50%, at least 60%, at least 70%, at least 80%), or at least 90% or more of the N-glycans of the polypeptide consists of such a glycan mixture. In certain embodiments, the method of producing a complex and G1 and/or G2 N-glycan will generate a mixture of different glycans. The complex N-glycan, Man3GlcNAc2, G1 and/or G2 may constitute at least 5%, at least 10%, at least 20%, at least 30%, at least 40%, at least 50%, at least 60%, at least 70%, at least 80%), or at least 90% or more of such a glycan mixture. In certain embodiments, at least 5%, at least 10%, at least 20%, at least 30%, at least 40%, at least 50%, at least 60%, at least 70%, at least 80%), or at least 90% or more of the N-glycans of the polypeptide consists of such a glycan mixture.

In certain embodiments, methods of producing a hybrid N-glycan are desirable. As used herein, the term "hybrid" means a glycan containing both unsubstituted terminal mannose residues (as are present in high-mannose glycans) and substituted mannose residues with an N-acetylglucosamine linkage, for example GlcNAcβ2Manα3[Manα3(Manα6)Manα6]Manβ4GlcNAcβ4GlcNAc. In such embodiments, a Man5 {i.e Manα3 [Manα3(Manα6) Manα6]Manβ4GlcNAcβ4GlcNAc} expressing filamentous fungal cell such as *T. reesei* strain is transformed with a recombinant polynucleotide encoding a heterologous polypeptide and a polynucleotide encoding an N-acetylglucosaminyltransferase I catalytic domain and the filamentous fungal cell is cultured to produce the hybrid N-glycan where the hybrid N-glycan constitutes at least 5%, at least 10%, at least 20%, at least 30%, at least 40%, at least 50%, at least 60%, at least 70%, at least 80%, at least 90%, or 100% (mol %) of the neutral N-glycans secreted by the filamentous fungal cell. In certain embodiment, at least 10%, at least 20%, at least 30%, at least 40%, at least 50%, at least 60%, at least 70%, at least 80%, at least 90%, or 100% (mol %) of the N-glycans of the polypeptide consists of a hybrid N-glycan.

The Man3GlcNAc2, complex, hybrid, G1, and G2 N-glycan may be attached to a molecule selected from an amino acid, a peptide, and a polypeptide. In certain embodiments, the Man3GlcNAc2, complex, hybrid, G1, and G2 N-glycan is attached to a heterologous polypeptide. In certain embodiments, the heterologous polypeptide is a glycosylated protein. In certain embodiment, the glycosylated polypeptide is a mammalian polypeptide. In certain embodiments, mammalian polypeptide is an antibody or its antigen-binding fragment.

In certain embodiments, glycosyltransferases, for example, GnTI, GnTII, or GalT or glycosylhydrolases, for example, α-1,2-mannosidase or mannosidase II, include a targeting peptide linked to the catalytic domains. The term "linked" as used herein means that two polymers of amino acid residues in the case of a polypeptide or two polymers of nucleotides in the case of a polynucleotide are either coupled directly adjacent to each other or are within the same polypeptide or polynucleotide but are separated by intervening amino acid residues or nucleotides. A "targeting peptide", as used herein, refers to any number of consecutive amino acid residues of the recombinant protein that are capable of localizing the recombinant protein to the endoplasmic reticulum (ER) or Golgi apparatus (Golgi) within the filamentous fungal cell. The targeting peptide may be N-terminal or C-terminal to the catalytic domains. In certain embodiments, the targeting peptide is N-terminal to the catalytic domains. In certain embodiments, the targeting peptide provides direct binding to the ER or Golgi membrane. Components of the targeting peptide may come from any enzyme that normally resides in the ER or Golgi apparatus. Such enzymes include mannosidases, mannosyltransferases, glycosyltransferases, Type 2 Golgi proteins, and MNN2, MNN4, MNN6, MNN9, MNN10, MNS1, KRE2, VAN1, and OCH1 enzymes. Suitable targeting peptides are described in the International Patent Publication No. WO2012/069593. In one embodiment, the targeting peptide of GnTI or GnTII is human GnTII enzyme. In other embodiments, targeting peptide is derived from *Trichoderma* Kre2, Kre2-like, Och1, Anp1, and Van1. In one embodiment, the targeting peptide is selected from the group of SEQ ID NOs: 589-594.

Uses of the Filamentous Fungal Cells of the Invention

The invention herein further relates to methods of using any of the filamentous fungal cells of the present disclosure, such as *Trichoderma* fungal cells, that have reduced or no protease activity of at least three proteases and that contain a recombinant polynucleotide encoding a heterologous polypeptide, such as a mammalian polypeptide, that is produced at increased levels, for improving heterologous polypeptide stability and for making a heterologous polypeptide. Methods of measuring protein stability and for making a heterologous polypeptide are well known, and include, without limitation, all the methods and techniques described in the present disclosure.

Accordingly, certain embodiments of the present disclosure relate to methods of improving heterologous polypeptide stability, by: a) providing a filamentous fungal cell of the present disclosure having reduced or no activity of at least three proteases, where the cell further contains a recombinant polynucleotide encoding a heterologous polypeptide; and b) culturing the cell such that the heterologous polypeptide is expressed, where the heterologous polypeptide has increased stability compared to a host cell not containing the mutations of the genes encoding the proteases. Other embodiments of the present disclosure relate to methods of improving mammalian polypeptide stability, by: a) providing a *Trichoderma* fungal cell of the present disclosure having reduced or no activity of at least three proteases, where the cell further contains a recombinant polynucleotide encoding a mammalian polypeptide; and b) culturing the cell such that the mammalian polypeptide is expressed, where the mammalian polypeptide has increased stability compared to a host cell not containing the mutations of the genes encoding the proteases. The filamentous fungal cell or *Trichoderma* fungal cell may be any cell described in the section entitled "Filamentous Fungal Cells of the Invention". Methods of measuring polypeptide stability and for culturing filamentous fungal and *Trichoderma* fungal cells are well known in the art, and include, without limitation, all the methods and techniques described in the present disclosure.

In certain embodiments, the stability of the heterologous polypeptide or mammalian polypeptide is increased by at least 2-fold, at least 3-fold, at least 4-fold, at least 5-fold, at least 6-fold, at least 7-fold, at least 8-fold, at least 9-fold, at least 10-fold, at least 15-fold, at least 20-fold, at least 25-fold, at least 30-fold, at least 40-fold, at least 50-fold, at least 60-fold, at least 70-fold, at least 75-fold, at least 80-fold, at least 90-fold, at least 100-fold, or a greater fold higher compared to a heterologous polypeptide or mammalian polypeptide expressed in a corresponding parental filamentous fungal or *Trichoderma* fungal cell.

Other embodiments of the present disclosure relate to methods of making a heterologous polypeptide, by: a) providing a filamentous fungal cell of the present disclosure having reduced or no activity of at least three proteases, where the cell further contains a recombinant polynucleotide encoding a heterologous polypeptide; b) culturing the host cell such that the heterologous polypeptide is expressed; and c) purifying the heterologous polypeptide. Further embodiments of the present disclosure relate to methods of making a mammalian polypeptide, by: a) providing a *Trichoderma* fungal cell of the present disclosure having reduced or no activity of at least three protease, where the cell further contains a recombinant polynucleotide encoding a mammalian polypeptide; b) culturing the host cell such that the mammalian polypeptide is expressed; and c) purifying the mammalian polypeptide. The filamentous fungal cell or *Trichoderma* fungal cell may be any cell described in the section entitled "Filamentous Fungal Cells of the Invention". Methods of culturing filamentous fungal and *Trichoderma* fungal cells and purifying polypeptides are well known in the art, and include, without limitation, all the methods and techniques described in the present disclosure.

In certain embodiments, the filamentous fungal cell or *Trichoderma* fungal cell is cultured at a pH range selected from pH 3.5 to 7; pH 3.5 to 6.5; pH 4 to 6; pH 4.3 to 5.7; pH 4.4 to 5.6; and pH 4.5 to 5.5. In certain embodiments, to produce an antibody the filamentous fungal cell or *Trichoderma* fungal cell is cultured at a pH range selected from 4.7 to 6.5; pH 4.8 to 6.0; pH 4.9 to 5.9; and pH 5.0 to 5.8.

In some embodiments, the heterologous polypeptide is a mammalian polypeptide. In other embodiments, the heterologous polypeptide is a non-mammalian polypeptide.

In certain embodiments, the mammalian polypeptide is selected from an immunoglobulin, immunoglobulin heavy chain, an immunoglobulin light chain, a monoclonal antibody, a hybrid antibody, an F(ab')2 antibody fragment, an F(ab) antibody fragment, an Fv molecule, a single-chain Fv antibody, a dimeric antibody fragment, a trimeric antibody fragment, a functional antibody fragment, a single domain antibody, multimeric single domain antibodies, an immunoadhesin, insulin-like growth factor 1, a growth hormone, insulin, and erythropoietin. In other embodiments, the mammalian protein is an immunoglobulin or insulin-like growth factor 1. In yet other embodiments, the mammalian protein is an antibody. In further embodiments, the yield of the mammalian polypeptide is at least 0.5, at least 1, at least 2, at least 3, at least 4, or at least 5 grams per liter. In certain embodiments, the mammalian polypeptide is an antibody, optionally, IgG1, IgG2, IgG3, or IgG4. In further embodiments, the yield of the antibody is at least 0.5, at least 1, at least 2, at least 3, at least 4, or at least 5 grams per liter. In still other embodiments, the mammalian polypeptide is a growth factor or a cytokine. In further embodiments, the yield of the growth factor or cytokine is at least 0.1, at least 0.2, at least 0.3, at least 0.4, at least 0.5, at least 1, at least 1.5, at least 2, at least 3, at least 4, or at least 5 grams per liter. In further embodiments, the mammalian polypeptide is an antibody, and the antibody contains at least 70%, at least 80%, at least 90%, at least 95%, or at least 98% of a natural antibody C-terminus and N-terminus without additional amino acid residues. In other embodiments, the mammalian polypeptide is an antibody, and the antibody contains at least 70%, at least 80%, at least 90%, at least 95%, or at least 98% of a natural antibody C-terminus and N-terminus that do not lack any C-terminal or N-terminal amino acid residues In certain embodiments where the mammalian polypeptide is purified from cell culture, the culture containing the mammalian polypeptide contains polypeptide fragments that make up a mass percentage that is less than 50%, less than 40%, less than 30%, less than 20%, or less than 10% of the mass of the produced polypeptides. In certain preferred embodiments, the mammalian polypeptide is an antibody, and the polypeptide fragments are heavy chain fragments and/or light chain fragments. In other embodiments, where the mammalian polypeptide is an antibody and the antibody purified from cell culture, the culture containing the antibody contains free heavy chains and/or free light chains that make up a mass percentage that is less than 50%, less than 40%, less than 30%, less than 20%, or less than 10% of the mass of the produced antibody. Methods of determining the mass percentage of polypeptide fragments are well known in the art and include, measuring signal intensity from an SDS-gel.

In further embodiments, the non-mammalian polypeptide is selected from an aminopeptidase, amylase, carbohydrase, carboxypeptidase, catalase, cellulase. chitinase, cutinase, deoxyribonuclease, esterase, alpha-galactosidase, beta-galactosidase, glucoamylase, alpha-glucosidase, beta-glucosidase, invertase, laccase, lipase, mutanase, oxidase, pectinolytic enzyme, peroxidase, phospholipase, phytase, polyphenoloxidase, proteolytic enzyme, ribonuclease, transglutaminase, and xylanase.

In certain embodiments of any of the disclosed methods, the method includes the further step of providing one or more, two or more, three or more, four or more, or five or more protease inhibitors. In certain embodiments, the protease inhibitors are peptides that are co-expressed with the mammalian polypeptide. In other embodiments, the inhibitors inhibit at least two, at least three, or at least four proteases from a protease family selected from aspartic proteases, trypsin-like serine proteases, subtilisin proteases, and glutamic proteases.

In certain embodiments of any of the disclosed methods, the filamentous fungal cell or *Trichoderma* fungal cell also contains a carrier protein. As used herein, a "carrier protein" is portion of a protein that is endogenous to and highly secreted by a filamentous fungal cell or *Trichoderma* fungal cell. Suitable carrier proteins include, without limitation, those of *T. reesei* mannanase I (Man5A, or MANI), *T. reesei* cellobiohydrolase II (Cel6A, or CBHII) (see, e.g., Paloheimo et al Appl. Environ. Microbiol. 2003 December; 69(12): 7073-7082) or *T. reesei* cellobiohydrolase I (CBHI). In some embodiments, the carrier protein is CBH1. In other embodiments, the carrier protein is a truncated *T. reesei* CBH1 protein that includes the CBH1 core region and part of the CBH1 linker region. In some embodiments, a carrier such as a cellobiohydrolase or its fragment is fused to an antibody light chain and/or an antibody heavy chain. In some embodiments, a carrier such as a cellobiohydrolase or its fragment is fused to insulin-like growth factor 1, growth hormone, insulin, interferon alpha 2b, fibroblast growth factor 21, or human serum albumin. In some embodiments, a carrier-antibody fusion polypeptide comprises a Kex2 cleavage site. In certain embodiments, Kex2, or other carrier cleaving enzyme, is endogenous to a filamentous fungal cell. In certain embodiments, carrier cleaving protease is heterologous to the filamentous fungal cell, for example, another Kex2 protein derived from yeast or a TEV protease. In certain embodiments, carrier cleaving enzyme is overexpressed. In certain embodiments, the carrier consists of about 469 to 478 amino acids of N-terminal part of the *T. reesei* CBH1 protein GenBank accession No. EGR44817.1. In one embodiment, the polynucleotide encoding the heterologous glycoprotein (e.g. the antibody) further comprises a polynucleotide encoding CBH1 catalytic domain and linker as a carrier protein, and/or cbh1 promoter. In certain embodiments, the filamentous fungal cell of the invention overexpress KEX2 protease. In an embodiment the heterologous glycoprotein (e.g. the antibody) is expressed as fusion construct comprising an endogenous fungal polypeptide, a protease site such as a Kex2 cleavage site, and the heterologous protein such as an antibody heavy and/or light chain. Useful 2-7 amino acids combinations preceding Kex2 cleavage site have been described, for example, in Mikosch et al. (1996) J. Biotechnol. 52:97-106; Goller et al. (1998) Appl Environ Microbiol. 64:3202-3208; Spencer et al. (1998) Eur. J. Biochem. 258:107-112; Jalving et al. (2000) Appl. Environ. Microbiol. 66:363-368; Ward et al. (2004) Appl. Environ. Microbiol. 70:2567-2576; Ahn et al. (2004) Appl. Microbiol. Biotechnol. 64:833-839; Paloheimo et al. (2007) Appl Environ Microbiol. 73:3215-3224; Paloheimo et al. (2003) Appl Environ Microbiol. 69:7073-7082; and Margolles-Clark et al. (1996) Eur J Biochem. 237:553-560.

It is to be understood that, while the invention has been described in conjunction with the certain specific embodiments thereof, the foregoing description is intended to illustrate and not limit the scope of the invention. Other aspects, advantages, and modifications within the scope of the invention will be apparent to those skilled in the art to which the invention pertains.

The invention having been described, the following examples are offered to illustrate the subject invention by way of illustration, not by way of limitation.

EXAMPLES

The identification of certain proteases in *Trichoderma reesei* and corresponding *T. reesei* cells with deficient protease activity have been described in Examples 1-23 of WO 2013/102674 which contents is incorporated herein by reference.

Example 1

Generation of Deletion Plasmids

The deletion plasmid below were constructed essentially as described for pep1 deletion plasmid pTTv41 in Example 1 of WO2013/102674, except that the marker used for selection was pyr4-hgh or pyr4 from pTTv213 or pTTv194.

Deletion Plasmid for amp1

958 bp of 5' flanking region and 994 bp of 3' flanking region were selected as the basis of the amp1 deletion plasmid pTTv240. A 367 bp stretch from the end of amp1 5' flank was used as the direct repeat fragment. These fragments were amplified by PCR using the primers listed in Table 1-1. Template used in the PCR of the flanking regions was from the *T. reesei* wild type strain QM6a. The products were separated with agarose gel electrophoresis and the correct fragments were isolated from the gel with a gel extraction kit (Qiagen) using standard laboratory methods. The pyr4-hph selection marker used in pTTv240 was obtained from pTTv213 (Δpep2-pyr-hph see Example 14 of WO2013/102674) with NotI digestion. To enable removal of the pyr4-hgh marker cassette, NotI restriction sites were introduced on both sides of the cassette. AscI site was introduced between the amp1 5'direct repeat and 3' flank. Vector backbone was EcoRI/XhoI digested pRS426 and the plasmid pTTv240 was constructed with the 5' flank, 3' flank, the 5' direct repeat, pyr4-hph marker, and vector backbone using the yeast homologous recombination method as described in Example 1 of WO2013/102674). The deletion plasmid for amp1 (pTTv240, Table 1-1) results in a deletion in the amp1 locus and covers the complete coding sequence of AMP1 (tre81070).

TABLE 1-1

Primers for generating amp1 deletion plasmid.
Deletion plasmid pTTv240 (Δamp1-pyr4-hph), vector backbone pRS426

| Primer | Sequence |
| --- | --- |
| T832_amp1_5flkfw_vector | GTAACGCCAGGGTTTTCCCAGTCACGACGGTTTAAACC ATGGAAGATGCGAGCTACA (SEQ ID NO: 806) |
| T833_amp1_5flkrev_pyr4Prom | GCGCTGGCAACGAGAGCAGAGCAGCAGTAGTCGATGC TAGGCGGCCGCGGAGAGGAGATGGGTGTTGA (SEQ ID NO: 807) |
| T836_amp1_3flkfw_5DR_end | CCCCCCTTTCTCTCTCTCTTTCAACACCCATCTCCTCTC CGGCGCGCCGCGAGGTGCGTTTCTGTAGC (SEQ ID NO: 808) |
| T837_amp1_3flkrev_vector | GCGGATAACAATTTCACACAGGAAACAGCGTTTAAAC CGGCAAATACTACGACACA (SEQ ID NO: 809) |
| T834_amp1_5 DR fwd | GTACACTTGTTTAGAGGTAATCCTTCTTTCTAGAAGGA GAGCGGCCGCGTCGAGTGCATCAATGACGA (SEQ ID NO: 810) |
| T835_amp1_5 DR rev | CAAACAGCATGCTCGTAAATGCTACAGAAACGCACCT CGCGGCGCGCCGGAGAGGAGATGGGTGTTGA (SEQ ID NO: 811) |

Deletion Plasmid for amp2

918 bp of 5' flanking region and 978 bp of 3' flanking region were selected as the basis of the amp2 deletion plasmid pTTv271. These fragments were amplified by PCR using the primers listed in Table 1-2. Template used in the PCR of the flanking regions was from the *T. reesei* wild type strain QM6a. The products were separated with agarose gel electrophoresis and the correct fragments were isolated from the gel with a gel extraction kit (Qiagen) using standard laboratory methods. The pyr4-hph cassette was obtained from pTTv194 (Δpep4-pyr-hph) with NotI digestion. To enable removal of the marker cassette, NotI restriction sites were introduced on both sides of the cassette. Vector backbone was EcoRI/XhoI digested pRS426 and the plasmid pTTv271 was constructed with the 5' flank, 3' flank, pyr4-hph marker, and vector backbone using the yeast homologous recombination method.

Another deletion plasmid for amp2 (pTTv327) was generated as follows. A 311 bp stretch from the end of amp2 5' flank was used as the direct repeat fragment. The fragments were amplified by PCR using the primers listed in Table 1-3. The products were separated with agarose gel electrophoresis and the correct fragments were isolated from the gel. The pyr4-hph cassette was obtained from pTTv210 (Δsep1-pyr4-hph) with NotI digestion. To enable removal of the marker cassette, NotI restriction sites were introduced on both sides of the cassette. AscI site was introduced between the amp2 5'direct repeat and 3' flank. Vector backbone was EcoRI/XhoI digested pRS426 and the plasmid was constructed as described in Example 1 of WO2013/102674.

These deletion plasmids for amp2 (pTTv271 and pTTv327) result in 2143 bp deletion in the amp2 locus and cover the complete coding sequence of AMP2 (tre108592).

TABLE 1-2

Primers for generating amp2 deletion plasmid.
Deletion plasmid pTTv271 (Δamp2-pyr4-hph), vector backbone pRS426

| Primer | Sequence |
| --- | --- |
| T1079_amp2_5flkfw_vector | GTAACGCCAGGGTTTTCCCAGTCACGACGGTTTAAACCC ATTCTCGTCGTTGTTTCC (SEQ ID NO: 812) |
| T1080_amp2_5flkrev_pyr4Prom | GCGCTGGCAACGAGAGCAGAGCAGCAGTAGTCGATGCTAGGC GGCCGCTGGAGGAGTAGCTGCACTGA (SEQ ID NO: 813) |
| T1081_amp2_3flkfw_pyr4loop | CAACCAGCCGCAGCCTCAGCCTCTCTCAGCCTCATCAGCCGCG GCCGCACAGCCAGTGGAAACCAAAC (SEQ ID NO: 814) |
| T1082_amp2_3flkrev_vector | GCGGATAACAATTTCACACAGGAAACAGCGTTTAAACTAGAGC TTGGAGGGAACAGG (SEQ ID NO: 815) |

TABLE 1-3

Primers for generating amp2 deletion plasmid.
Deletion plasmid pTTv327 (Δamp2-pyr4-hph), vector backbone pRS426

| Primer | Sequence |
| --- | --- |
| T1079_amp2_5flkfw_vecfor | GTAACGCCAGGGTTTTCCCAGTCACGACGGTTTAAAC CCATTCTCGTCGTTGTTTCC (SEQ ID NO: 812) |
| T1080_amp2_5flkrev_pyr4Prom | GCGCTGGCAACGAGAGCAGAGCAGCAGTAGTCGAT GCTAGGCGGCCGCTGGAGGAGTAGCTGCACTGA (SEQ ID NO: 813) |
| T1194_amp2_5dr_f | GTACACTTGTTTAGAGGTAATCCTTCTTTCTAGAAGGA GAGCGGCCGCGAGTCGGTCCTACTGCTTGA (SEQ ID NO: 816) |
| T1195_amp2_5dr_r | TTTTACTTGTTTTGATAAGGGTTTGGTTTCCACTGGCTG TGGCGCGCCTGGAGGAGTAGCTGCACTGA (SEQ ID NO: 817) |
| T1196_amp2_3f_f_2 | ACAGCCAGTGGAAACCAAAC (SEQ ID NO: 818) |
| T1082_amp2_3flkrev_vector | GCGGATAACAATTTCACACAGGAAACAGCGTTTAAAC TAGAGCTTGGAGGGAACAGG (SEQ ID NO: 815) |

Deletion Plasmid for sep1

First deletion plasmid for sep1, pTTv210, contained 1099 bp 5' flanking region and 806 bp 3' flanking region, a 300 bp strech from the end of sep1 5' flank as the direct repeat fragment, pyr4-hph double selection marker and an expression construct for *T. reesei* native kex2 (tre123561; promoter cDNA1-kex2-terminator cbh2). All other fragments except pyr4 were amplified by PCR using the primers listed in Table 1-4. Template used in the PCR of the flanking regions, direct repeat, kex2 and terminator was from the *T. reesei* wild type strain QM6a. Templates for cDNA1 promoter and hph marker were plasmids. The pyr4 marker was obtained from pTTv181 with NotI digestion (pTTv181 is described in Example 4 of WO2013/102674). To enable removal of the pyr4-hph marker cassette, NotI restriction sites were introduced on both sides of the cassette. AscI site was introduced between the sep1 5'direct repeat and 3' flank. The products were separated with agarose gel electrophoresis and the correct fragments were isolated from the gel with a gel extraction kit (Qiagen). Vector backbone was EcoRI/XhoI digested pRS426. Plasmid pTTv210 was constructed with all eight fragments above and vector backbone using the yeast homologous recombination method as described above.

The second deletion plasmid for sep1, pTTv247, was constructed by removing the KEX2 overexpression cassette from pTTv210 with AscI digestion. The fragments were separated with agarose gel electrophoresis and the vector part isolated from the gel with a gel extraction kit (Qiagen). pTTv247 was cloned by self-ligation using T4 DNA ligase and standard laboratory methods.

Third deletion plasmid pTTv255 for sep1 was constructed as follows. 1099 bp of 5' flanking region and 806 bp of 3' flanking region were selected as the basis and a 300 bp stretch from the end of sep1 5' flank was used as the direct repeat fragment. These fragments were amplified by PCR using the primers listed in Table 1-4. The pyr4 cassette was obtained from pTTv181 (Δpep4-pyr4) with NotI digestion. To enable removal of the marker cassette, NotI restriction sites were introduced on both sides of the cassette. AscI site was introduced between the sep1 5'direct repeat and 3' flank. Vector backbone was EcoRI/XhoI digested pRS426 and the plasmid was constructed using the yeast homologous recombination as above.

The deletion plasmids pTTv210, pTTv247 and pTTv255 result in 2519 bp deletion in the sep1 locus and cover the complete coding sequence of SEP1 (tre124051).

TABLE 1-4

Primers for generating sep1 deletion plasmids.

| Primer | Primer sequence |
|---|---|
| Deletion plasmid pTTv210 (Δsep1-pyr4-hph, kex2), vector backbone pRS426 | |
| T489_serendo_5f_for | GGTAACGCCAGGGTTTTCC CAGTCACGACGGTTTAAAC ATGGGCTGAAACCGGCGCA A (SEQ ID NO: 819) |
| T490_serendo_5f_rev | GCGCTGGCAACGAGAGCAG AGCAGCAGTAGTCGATGCT AGGCGGCCGCGACAGCGCC TCGCCAAGTGT (SEQ ID NO: 820) |
| T493_serendo_DR_for | GTACACTTGTTTAGAGGTA ATCCTTCTTTCTAGAAGGA GAGCGGCCGCAGCAGCCTG CCCAGAGAATC (SEQ ID NO: 821) |
| T494_serendo_DR_rev | GTCATTAAGTCCATCATTC CACGTCCTTCAGACCGAAT TCGGCGCGCCGACAGCGCC TCGCCAAGTGT (SEQ ID NO: 822) |
| T498_serendo_3f_for | ATGATGCCTTTGCAGAAAT GGCTTGCTCGCTGACTGAT ACGGCGCGCCTGGCGCTTC CGTTCCCTTCC (SEQ ID NO: 823) |
| T499_serendo_3f_rev | AGCGGATAACAATTTCACA CAGGAAACAGCGTTTAAAC TGTTGAGACGGGCGAGTGC T (SEQ ID NO: 824) |
| T491_hph_recpyr4_for3 | TGATTGTACCCCAGCTGCG ATTGATGTGTATCTTTGCA TGATTTAAATTCTCCTTAG CTCTGTACAGT (SEQ ID NO: 607) |
| T492_hph_rev2 | GCGGCCGCTCTCCTTCTAG AAAGAAGGA (SEQ ID NO :608) |
| T495_cDNA1_for | GAATTCGGTCTGAAGGACG T (SEQ ID NO: 609) |
| T138_cDNA1_Rev | GTTGAGAGAAGTTGTTGGA TTG (SEQ ID NO: 392) |
| T139_123561For_cDNA1 | AACCAAAGACTTTTTGATC AATCCAACAACTTCTCTCA ACATGAAGATTTCCTCGAT CCTTG (SEQ ID NO: 393) |
| T516_123561Rev | TCAGCGCCGTAACCTCTGC (SEQ ID NO: 394) |
| T496_tcbh2_for | TGATGGTGATGAGGCGGAA AAGCAGAGGTTACGGCGCT GAGGCTTTCGTGACCGGGC TTC (SEQ ID NO: 610) |
| T497_tcbh2_rev | GTATCAGTCAGCGAGCAAG C (SEQ ID NO: 611) |
| Deletion plasmid pTTv247 (Δsep1-pyr4-hph), vector backbone pTTv210 | |
| No new primers; pTTv210 digested with AscI (to remove kex2 cassette) and ~12 kb fragment self-ligated | |
| Deletion plasmid pTTv255 (Δsep1-pyr4), vector backbone pRS426 | |
| T489_serendo_5f_for | GGTAACGCCAGGGTTTTCC AGTCACGACGGTTTAAACAT GGGCTGAAACCGGCGCAA (SEQ ID NO: 819) |

TABLE 1-4-continued

Primers for generating sep1 deletion plasmids.

| Primer | Primer sequence |
|---|---|
| T490_serendo_5f_rev | GCGCTGGCAACGAGAGCAGA GCAGCAGTAGTCGATGCTAG GCGGCCGCGACAGCGCCTCG CCAAGTGT (SEQ ID NO: 820) |
| T1000_serendo_5dr_for2 | TGATTGTACCCCAGCTGCGA TTGATGTGTATCTTTGCATG GCGGCCGCAGCAGCCTGCCC AGAGAATC (SEQ ID NO: 825) |
| T1001_serendo_5dr_rev2 | GACAATCAGAGGCCTCAATT GGAAGGGAACGGAAGCGCCA GGCGCGCCGACAGCGCCTCG CCAAGTGT (SEQ ID NO: 826) |
| T502_serendo_3f_probef | TGGCGCTTCCGTTCCCTTCC (SEQ ID NO: 827) |
| T499_serendo_3f_rev | AGCGGATAACAATTTCACAC AGGAAACAGCGTTTAAACTG TTGAGACGGGCGAGTGCT (SEQ ID NO: 824) |

Deletion Plasmids for pep9

918 bp of 5' flanking region and 978 bp of 3' flanking region were selected as the basis of the pep9 deletion plasmid pTTv267. These fragments were amplified by PCR using the primers listed in Table 1-5. Template used in the PCR of the flanking regions was from the *T. reesei* wild type strain QM6a. The products were separated with agarose gel electrophoresis and the correct fragments were isolated from the gel with a gel extraction kit (Qiagen). The pyr4-hph cassette was obtained from pTTv194 (Δpep4-pyr-hph) with NotI digestion. To enable removal of the marker cassette, NotI restriction sites were introduced on both sides of the cassette. Vector backbone was EcoRI/XhoI digested pRS426 and the plasmid was constructed with the 5' flank, 3' flank, pyr4-hph marker, and vector backbone using the yeast homologous recombination method. This deletion plasmid for pep9 (pTTv267, Table 1-5) results in a 1448 bp deletion in the pep9 locus and covers majority of the coding sequence PEP9 (tre79807).

TABLE 1-5

Primers for generating pep9 deletion plasmid. Deletion plasmid pTTv267 (Δpep9-pyr4-hph), vector backbone pRS426

| Primer | Sequence |
|---|---|
| T1027_pep9_5flkfw_vector | GTAACGCCAGGGTTTTCCC AGTCACGACGGTTTAAACA ACCACGACGAAAATCAAGG (SEQ ID NO: 828) |
| T1028_pep9_5flkrev_pyr4Prom | GCGCTGGCAACGAGAGCAG AGCAGCAGTAGTCGATGCT AGGCGGCCGCAATGGACCC AGATGTCAAGG (SEQ ID NO: 829) |
| T1029_pep9_3flkfw_pyr4loop | CAACCAGCCGCAGCCTCAG CCTCTCTCAGCCTCATCAG CCGCGGCCGCGATCTAGGA TTCGCCAAACG (SEQ ID NO: 830) |

TABLE 1-5-continued

Primers for generating pep9 deletion plasmid. Deletion plasmid pTTv267 (Δpep9-pyr4-hph), vector backbone pRS426

| Primer | Sequence |
|---|---|
| T1030_pep9_3flkrev_vector | GCGGATAACAATTTCACAC AGGAAACAGCGTTTAAACA CGACATGAACAAACGGACA (SEQ ID NO: 831) |

The second deletion plasmid for pep9, pTTv421, was constructed using the plasmid pTTv267 above as the backbone. The pyr4-hph double marker with pyr4 5DR was removed from pTTv267 with NotI digestion. New marker, pyr4-hph, was obtained from a plasmid derived from pTTv264 with egl2 deletion with NotI digestion. To enable removal of the marker cassette, NotI restriction sites were introduced on both sides of the cassette. FseI site was introduced between the pep9 3'direct repeat and 5' flank A 321 bp stretch from the beginning of pep9 3' flank was used as the direct repeat fragment. Part of the cbh2 terminator was used as a bridge in cloning. These two fragments were amplified by PCR using the primers listed in Table 1-6.

The third deletion plasmid for pep9, pTTv426, was constructed using the plasmid pTTv421 above as the backbone. The pyr4-hph double marker was removed from pTTv421 with NotI digestion. The pyr4 marker gene was obtained from pTTv181 (Δpep4-pyr4) with NotI digestion. Cloning of the plasmid pTTv426 was done with quick ligation using T4 DNA ligase at room temperature. Part of the ligation mixture was transformed into *E. coli* with electroporation. A few clones were cultivated, plasmid DNA was isolated and digested to screen for correct ligation using standard laboratory methods. Correct ligation and orientation of the marker was further verified by sequencing. These deletion plasmids for pep9 (pTTv421 and pTTv426, Table 1-6) result in a 1448 bp deletion in the pep9 locus and cover majority of the coding sequence of PEP9 (tre79807).

TABLE 1-6

Primers for generating pep9 deletion plasmids pTTv421 and pTTv426.

| Primer | Primer sequence |
|---|---|
| Deletion plasmid pTTv421 (Δpep9-pyr4-hph), vector backbone pTTv267 | |
| T1520_pep9_3dr_for | TAATCTCTAATCACCTAATA CCTTGACATCTGGGTCCATT GGCCGGCCGATCTAGGATTC GCCAAACG (SEQ ID NO: 832) |
| T1521_pep9_3dr_rev | GCGCTGGCAACGAGAGCAGA GCAGCAGTAGTCGATGCTAG GCGGCCGCAGTATCGCAGGA GCGAGCAT (SEQ ID NO: 833) |
| T1404_cbh2term_for | CCGTCTAGCGCTGTTGATTG (SEQ ID NO: 834) |

TABLE 1-6-continued

Primers for generating pep9 deletion
plasmids pTTv421 and pTTv426.

| Primer | Primer sequence |
|---|---|
| T1522_tcbh2_recpep9_rev | GCTGGATGAACGTTTGGCGA<br>ATCCTAGATCGCGGCCGCGT<br>GCTGCGGAATCATTATCA<br>(SEQ ID NO: 835) |

Deletion plasmid pTTv426 (Δpep9-pyr4),
vector backbone pTTv421

No new primers; pTTv421 digested with NotI
and ligated with pyr4 from pTTv181.

Deletion Plasmid for slp7

The deletion plasmid pTTv329 for slp7 (tre123865) was constructed essentially as described for pTTv269 except the additional primers used in Table 1-7, the pyr4-hph cassette was obtained from pTTv210 (Δsep1-pyr4-hph), and AscI site was introduced between the slp7 5'direct repeat and 3' flank.

TABLE 1-7

Additional primers for generating
slp7 deletion plasmid pTTv329.
Deletion plasmid pTTv329 (Δslp7-pyr4-hph),
vector backbone pRS426

| Primer | Primer sequence |
|---|---|
| T1200_slp7_5dr_f | GTACACTTGTTTAGAGGTAATCCTTCTTT<br>CTAGAAGGAGAGCGGCCGCGGGGAAACAA<br>TGACATACGC (SEQ ID NO: 836) |
| T1201_slp7_5dr_r | CTCTTGGAGAGTCTTCTCCAAAACCCAAG<br>CTTATCACCCAGGCGCGCCTTTGCAGCAA<br>GATGTCGTTC (SEQ ID NO: 837) |
| T1202_slp7_3f_f2 | TGGGTGATAAGCTTGGGTTT<br>(SEQ ID NO: 838) |

Deletion Plasmid for slp3

The deletion plasmid pTTv116 for slp3 (tre123234) is described in Example 3 of WO2013/102674. This plasmid results in 1597 bp deletion in the slp3 locus and covers the complete coding sequence of SLP3.

Second deletion plasmid for slp3, pTTv420, was cloned using pTTv116 as backbone. Marker from pTTv116 was removed by NotI digestion. New marker, pyr4-hph, was obtained from a plasmid derived from pTTv264 with egl2 deletion with NotI digestion. To enable removal of the marker cassette, NotI restriction sites were introduced on both sides of the cassette. FseI site was introduced between the slp3 3'direct repeat and 5' flank. A 300 bp stretch from the beginning of slp3 3' flank was used as the direct repeat fragment. Part of the cbh2 terminator was used as a bridge in cloning. These two fragments were amplified by PCR using the primers listed in Table 1-8. The products were separated with agarose gel electrophoresis and the correct fragments were isolated from the gel with a gel extraction kit (Qiagen). The plasmid was constructed using the yeast homologous recombination method as described above.

The third deletion plasmid for slp3, pTTv425, was constructed using the plasmid pTTv420 above as the backbone. The pyr4-hph double marker was removed from pTTv420 with NotI digestion. The pyr4 marker gene was obtained from pTTv181 (Δpep4-pyr4) with NotI digestion. Cloning of the plasmid pTTv425 was done with quick ligation using T4 DNA ligase at room temperature. Part of the ligation mixture was transformed into *E. coli* with electroporation. A few clones were cultivated, plasmid DNA was isolated and digested to screen for correct ligation using standard laboratory methods. Correct ligation and orientation of the marker was further verified by sequencing. These three deletion plasmids for slp3 (pTTv116, pTTv420 and pTTv425; Table 1-8) result in 1597 bp deletion in the slp3 locus and cover the complete coding sequence of SLP3.

TABLE 1-8

Primers for generating slp3
deletion plasmids pTTv420 and pTTv425.

| Primer | Primer sequence |
|---|---|
| Deletion plasmid pTTv420 (Δslp3-pyr4-hph),<br>vector backbone pTTv116 | |
| T1523_slp3_3dr_for | TCTTCTTGACACAATG<br>TTCCTGTTCTCCTCAT<br>CCTTGGATGGCCGGCC<br>ACCTAATGGTTTCTTC<br>GTTT<br>(SEQ ID NO: 839) |
| T1524_slp3_3dr_rev | GCGCTGGCAACGAGAG<br>CAGAGCAGCAGTAGTC<br>GATGCTAGGCGGCCGC<br>CTGGAGAGGATATGGT<br>TCTG<br>(SEQ ID NO: 840) |
| T1404_cbh2term_for | CCGTCTAGCGCTGTTG<br>ATTG<br>(SEQ ID NO: 834) |
| T1525_tcbh2_recslp3_rev | CACCAAAGAAAAACGA<br>AGAAACCATTAGGTGC<br>GGCCGCGTGCTGCGGA<br>ATCATTATCA<br>(SEQ ID NO: 841) |

Deletion plasmid pTTv425 (Δslp3-pyr4),
vector backbone pTTv420

No new primers; pTTv420 digested with NotI
and ligated with pyr4 from pTTv181.

Deletion Plasmids for pep2 with slp2 RNAi

The selection markers in vectors pTTv217 and pTTv263 (both vectors silencing slp2) were switched to a pyr4-hgh double marker. The vectors were digested with NotI restriction enzyme and the vector was purified from agarose gel. The pyr4-hgh cassette was obtained from pTTv194 (Δpep4-pyr-hgh) with NotI digestion. The new double marker and the vectors were ligated together and transformed to DH5α chemically competent *E. coli*. The resulting vectors pTTv376 and pTTv405 were amplified and purified.

Example 2

Generation of 10-Fold Protease Deletion Strain with sep1 Deletion (M659)

To generate a 10-fold protease deletion strain, removal of the pyr4 marker was applied to the 9-fold deletion strain M574 (described in Example 14 of WO2013/102674) essentially as described in Example 3 of WO2013/102674 for removal of the pyr4 blaster cassette from the strain M195 (Δpep1). Consecutive 5-FOA selection steps were carried out to ensure that the clones selected were originating from single cells.

Final clones were verified by PCR using the primers listed in Table 25-1. Signal corresponding to successful removal of the blaster cassette was obtained for majority of the clones. Removal of the blaster cassette was further verified by plating the clones onto minimal medium plates with or without 5 mM uridine. Resulting strain used in generation of 10-fold protease deletion strain was designated with strain number M597.

To remove vector sequence, plasmid pTTv255 (Δpep1-pyr4) was digested with MssI and the correct fragment purified from an agarose gel using a QIAquick Gel Extraction Kit (Qiagen). Approximately 5 μg of the deletion cassette was used to transform 9-fold protease deletion strain M597 (Δpep1Δtsp1Δslp1Δgap1Δgap2Δpep4Δpep3Δpep5Δpep2, pyr4−). Preparation of protoplasts and transformation were carried out essentially as described for the strains M181 and M195 using pyr4 selection in WO2013/102674.

Transformants were picked as first streaks. Growing streaks were screened by PCR (using the primers listed in Table 2-1) for correct integration. Clones giving the expected signals were purified to single cell clones and rescreened by PCR using the primers listed in Table 2-1. Deletion of sep1 was verified by Southern analyses from selected clones (FIG. 1 A, B, C) using methods described above. Clone 48-70C was designated with strain number M633. An additional single cell purification step was applied to strain M633 to obtain 10-fold protease deletion strain M659 (clone 48-70C-2).

TABLE 2-1

Primers for screening removal of pyr4 blaster cassette from 9-fold protease deletion strain and for screening pTTv255/Δsep1-pyr4 integration and strain purity.

| Primer | Sequence |
|---|---|
| For screening removal of pyr4 blaster cassette from M574 and strain purity | |
| T1162_pep2_5f_f2 | CTGTAAAGGCAGCATCGG (SEQ ID NO: 638) |
| T1163_pep2_3f_r2 | TCAGAACGGCTTCAATCATT (SEQ ID NO: 639) |
| T488_pyr4_5utr_rev | GGAGTTGCTTTAATGTCGGG (SEQ ID NO: 428) |
| T601_pep2 fwd | GACGTGGTACGACAACATCG (SEQ ID NO: 269) |
| T623_pep2 rev | TATCAAGGTACCGGGGACAG (SEQ ID NO: 270) |
| For screening integration of pTTv255 (Δsep1-pyr4) | |
| T519_serendo_5int | AACCACCTTGTTCTGTCCGT (SEQ ID NO: 842) |
| T488_pyr4_5utr_rev | GGAGTTGCTTTAATGTCGGG (SEQ ID NO: 428) |
| T061_pyr4_orf_screen_2F | TTAGGCGACCTCTTTTTCCA (SEQ ID NO: 382) |
| T521_serendo_3int | GGAACTGTCAAGATCTGGGA (SEQ ID NO: 843) |
| For screening deletion of sep1 ORF | |
| T1059_serendo_orf_probef2 | CTTCTGCAAGGAGGACGATT (SEQ ID NO: 844) |

TABLE 2-1-continued

Primers for screening removal of pyr4 blaster cassette from 9-fold protease deletion strain and for screening pTTv255/Δsep1-pyr4 integration and strain purity.

| Primer | Sequence |
|---|---|
| T1060_serendo_orf_prober2 | GCGATGCCGTACGTGTAC (SEQ ID NO: 845) |

Example 3

Generation of 11-Fold Protease Deletion Strain with slp8 Deletion (M750)

The deletion plasmid pTTv330 for subtilisin-like protease slp8 (tre58698) is described in Example 12 of WO2013/102674.

To generate a 11-fold protease deletion strain, removal of the pyr4 marker was applied to the 10-fold deletion strain M633 essentially as described above. Consecutive 5-FOA selection steps were carried out to ensure that the clones selected were originating from single cells.

Final clones were verified by PCR using the primers listed in Table 3-1. Signal corresponding to successful removal of the blaster cassette was obtained for majority of the clones. Removal of the blaster cassette was further verified by plating the clones onto minimal medium plates with or without 5 mM uridine. and resulting strain used in generation of 11-fold protease deletion strain was designated with strain number M637 (clone 1-G).

To remove vector sequence, plasmid pTTv330 (Δslp8-pyr4-hph) was digested with MssI+SbfI and the correct fragment purified from an agarose gel using a QIAquick Gel Extraction Kit (Qiagen). Approximately 5 μg of the deletion cassette was used to transform 10-fold protease deletion strain M637 (Δpep1Δtsp1Δslp1Δgap1Δgap2Δpep4Δpep3Δpep5Δpep2Δsep1, pyr4−). Preparation of protoplasts and transformation were carried out essentially as described above.

Figure 2:
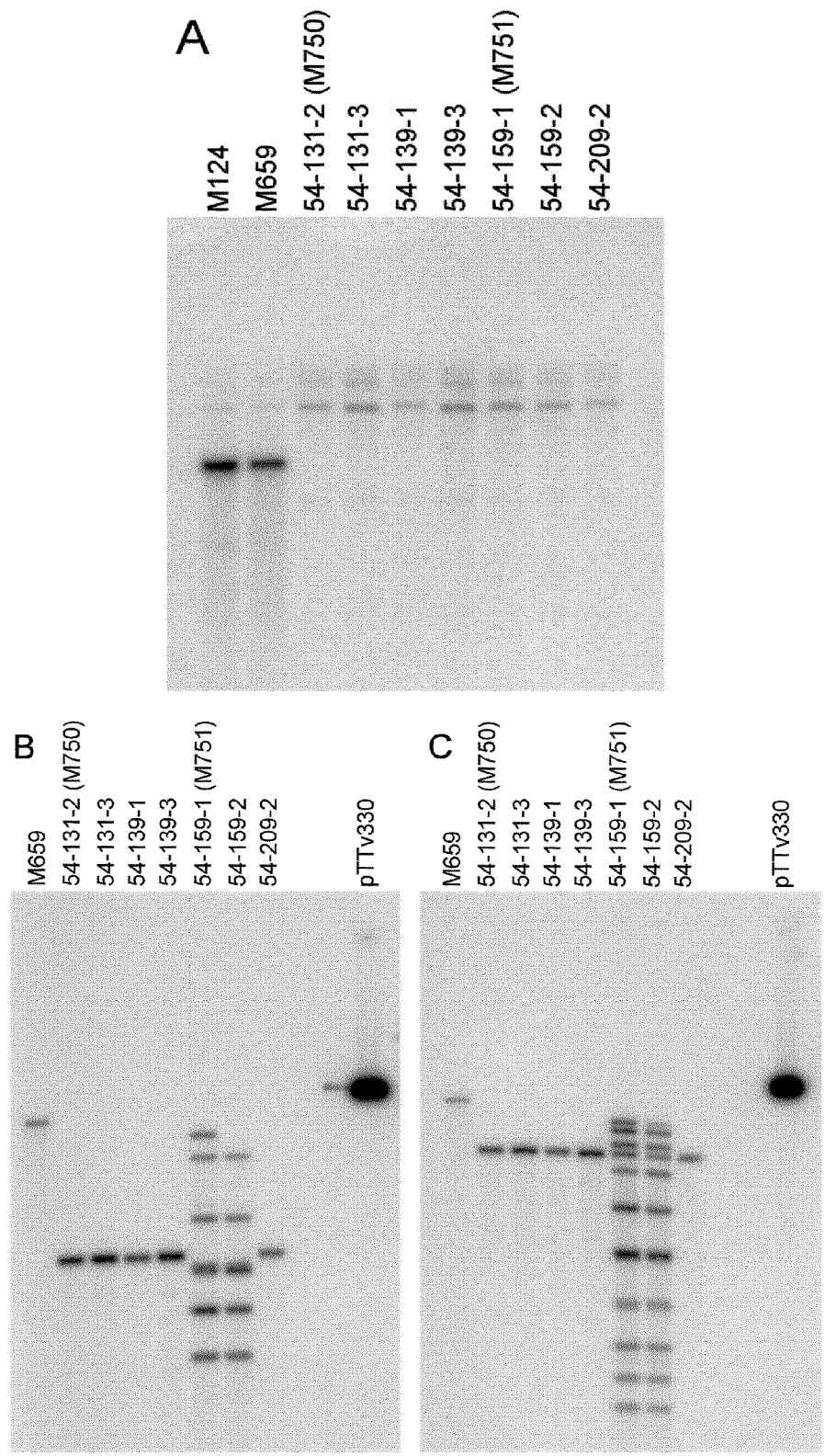
FIG. 2 depicts Southern blot analysis showing the generation of the 11-fold protease deletion strain M750 (54-131-2). Figure A depicts the expected signal of slp8 ORF: 5.6 kb from M124 (Δ0) and M659 (Δ10), no signal from the transformants. The faint signal pattern seen in all samples is unspecific background. Figure B depicts the expected signal of slp8 5' flank: 5.6 kb from M659, 2.9 kb from transformants, 6.7 kb from pTTv330. Figure C depicts the expected signal of slp8 3' flank: 5.6 kb from M659, 4.2 kb from transformants, 6.7 kb from pTTv330. Strain M751 (54-159-1) shows multiple signals with both probes indicating integration of several deletion cassettes to the genome and putatively also genomic rearrangements.

Transformants were picked as first streaks. Growing streaks were screened by PCR (using the primers listed in Table 3-1) for correct integration and clones giving the expected signals were purified to single cell clones and rescreened by PCR using the primers listed in Table 3-1. Deletion of slp8 was verified by Southern analyses from selected clones (FIG. 2 A, B, C) using methods described above. Clone 54-131-2 was designated with strain number M750.

TABLE 3-1

Primers for screening removal of pyr4 blaster cassette from 10-fold protease deletion strain and for screening pTTv330/Δslp8-pyr4-hph integration and strain purity.

| Primer | Sequence |
|---|---|
| For screening removal of pyr4 blaster cassette from M633 and strain purity | |
| T1173_sep1_5f_f2 | TAGGTCTCGGCTGACAAGG (SEQ ID NO: 846) |
| T1174_sep1_3f_r2 | GCTTCTTCCACTGAATGCTC (SEQ ID NO: 847) |

TABLE 3-1-continued

Primers for screening removal of pyr4 blaster cassette from 10-fold protease deletion strain and for screening pTTv330/Δslp8-pyr4-hph integration and strain purity.

| Primer | Sequence |
| --- | --- |
| T488_pyr4_5utr_rev | GGAGTTGCTTTAATGTCGGG (SEQ ID NO: 428) |
| T1059_serendo_orf_probef2 | CTTCTGCAAGGAGGACGATT (SEQ ID NO: 844) |
| T1060_serendo_orf_prober2 | GCGATGCCGTACGTGTAC (SEQ ID NO: 845) |
| For screening integration of pTTv330 (Δslp8-pyr4-hph) | |
| T1298_slp8_5int | CATCACCAAGAAGGTCCCTC (SEQ ID NO: 848) |
| T488_pyr4_5utr_rev | GGAGTTGCTTTAATGTCGGG (SEQ ID NO: 428) |
| T061_pyr4_orf_screen_2F | TTAGGCGACCTCTTTTTCCA (SEQ ID NO: 382) |
| T1299_slp8_3int | ACTCAATGGAACCACATCGA (SEQ ID NO: 849) |
| For screening deletion of slp8 ORF | |
| T1300_slp8_orf_for | CTGTGGTTGAGTGCAGATG (SEQ ID NO: 850) |
| T1301_slp8_orf_rev | TCCCACACATCAACACAAGT (SEQ ID NO: 851) |

Example 4

Generation of 12-Fold Protease Deletion Strain with amp2 Deletion (M893)

To generate a 12-fold protease deletion strain, removal of the pyr4-hph double marker was applied to the 11-fold deletion strain M750 essentially as described above. Consecutive 5-FOA selection steps were carried out to ensure that the clones selected were originating from single cells.

Final clones were verified by PCR using the primers listed in Table 4-1. Signal corresponding to successful removal of the blaster cassette was obtained for majority of the clones. Removal of the blaster cassette was further verified by plating the clones onto minimal medium plates with or without 5 mM uridine. In addition, clones were tested also on hygromycin plates with or without 5 mM uridine. No growth was observed on the plates without uridine supplementation or if plates contained hygromycin. Resulting marker-free strain used in generation of 12-fold protease deletion strain was designated with strain number M780 (clone 1AH).

To remove vector sequence, plasmid pTTv327 (Δamp2-pyr4-hph) was digested with MssI+SbfI and the correct fragment purified from an agarose gel using a QIAquick Gel Extraction Kit (Qiagen). More than 6 µg of the deletion cassette was used to transform 11-fold protease deletion strain M780 (Δpep1Δtsp1Δslp1Δgap1Δgap2Δpep4Δpep3Δpep5Δpep2Δsep1Δslp8, pyr4−, hph−). Preparation of protoplasts and transformation were carried out essentially as above.

Figure 3:
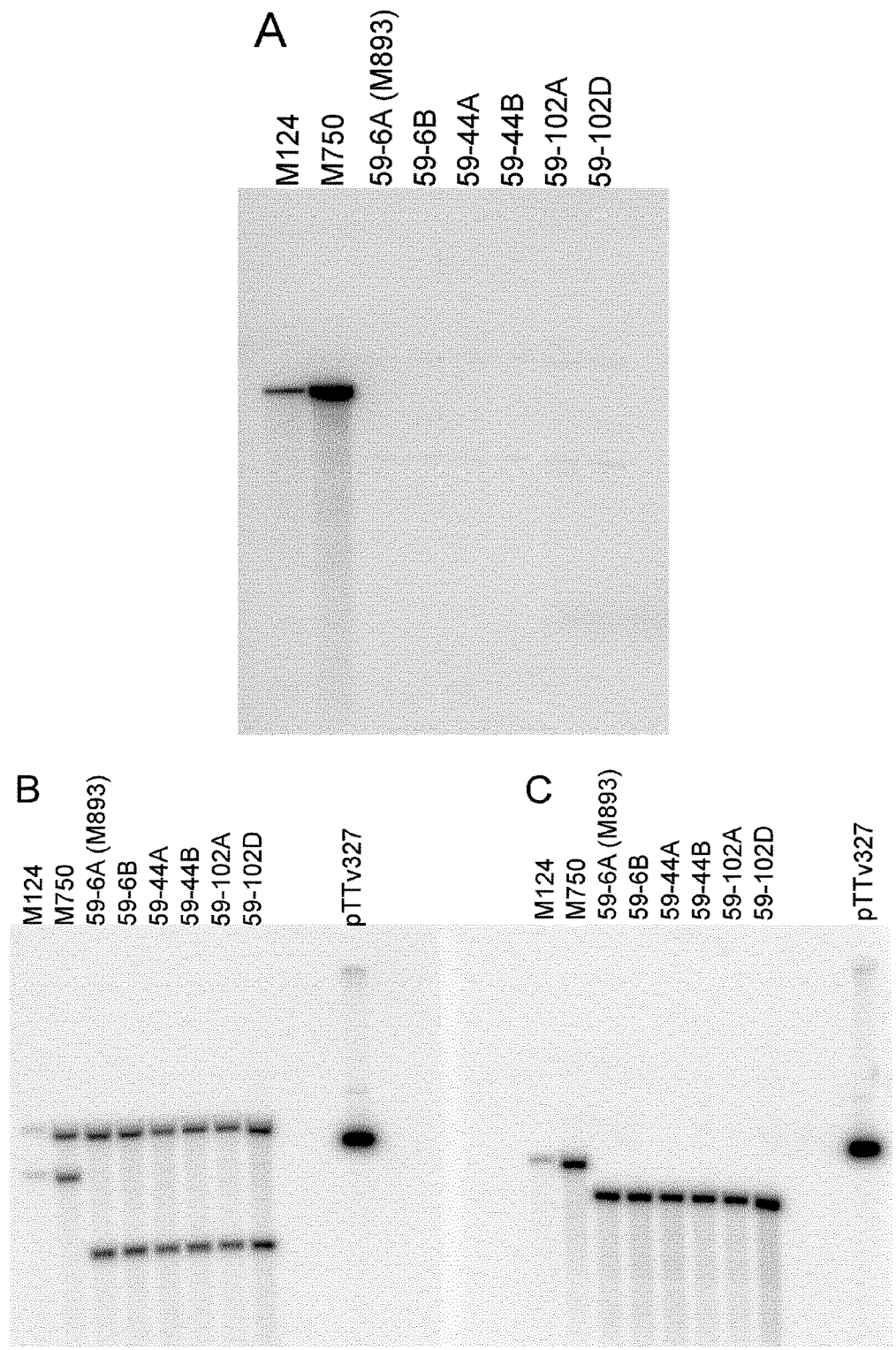
FIG. 3 depicts Southern blot analysis showing the generation of the 12-fold protease deletion strain M893 (59-6A). Figure A depicts the expected signal of amp2 ORF: 5.5 kb from M124 (Δ0) and M750 (Δ11), no signal from the transformants. Figure B depicts the expected signal of amp2 5' flank: 5.5 kb from M124 and M750, 3.6 kb from transformants, 6.6 kb from pTTv327. Signal seen at approximately 7 kb for all samples is unspecific background. Figure C depicts the expected signal of amp2 3' flank: 5.5 kb from M124 and M750, 4.5 kb from transformants, 6.6 kb from pTTv327.

Transformants were picked as first streaks. Growing streaks were screened by PCR (using the primers listed in Table 4-1) for correct integration. Clones giving the expected signals were purified to single cell clones and rescreened by PCR using the primers listed in Table 4-1. Deletion of amp2 was verified by Southern analyses from selected clones (FIG. 3 A, B, C). Clone 59-6A was designated with strain number M893.

TABLE 4-1

Primers for screening removal of pyr4-hph blaster cassette from 11-fold protease deletion strain and for screening pTTv327/Δamp2-pyr4-hph integration and strain purity.

| Primer | Sequence |
| --- | --- |
| For screening removal of pyr4-hph blaster cassette from M750 and strain purity | |
| T047_trpC_term_end_F | CCTATGAGTCGTTTACCCAGA (SEQ ID NO: 426) |
| T1299_slp8_3int | ACTCAATGGAACCACATCGA (SEQ ID NO: 849) |
| T061_pyr4_orf_screen_2F | TTAGGCGACCTCTTTTTCCA (SEQ ID NO: 382) |
| T624_gpdA_seqR1 | CTCCATATTCTCCGATGATGC (SEQ ID NO: 852) |
| T1420_slp8_5f_f2 | TGAATTTGTTGGATCCCTGC (SEQ ID NO: 853) |
| T1421_slp8_3f_r2 | TACCCAGGTCAAAAGAGCAG (SEQ ID NO: 854) |
| T1292_Hygrorf_For | GCCTGAACTCACCGCGACG (SEQ ID NO: 855) |
| T1293_Hygrorf_Rev | CCTTTGCCCTCGGACGAGTG (SEQ ID NO: 856) |
| For screening integration of pTTv327 (Δamp2-pyr4-hph) | |
| T1083_amp2_screen_5flk_fwd | CCACTGAAGGGGAGTTTTCA (SEQ ID NO: 857) |
| T488_pyr4_5utr_rev | GGAGTTGCTTTAATGTCGGG (SEQ ID NO: 428) |
| T047_trpC_term_end_F | CCTATGAGTCGTTTACCCAGA (SEQ ID NO: 426) |
| T1085_amp2_screen_3flk_rev | TCGCGGTATCGTATGAGATG (SEQ ID NO: 858) |
| For screening deletion of amp2 ORF | |
| T1086_amp2_orf_fwd | GCCAGCTTCAACATCGACTT (SEQ ID NO: 859) |
| T1087_amp2_orf_rev | CAGCACGAGCACGTTGTACT (SEQ ID NO: 860) |

Example 5

The 13-Fold Protease Deletion Strain Having Deletions Δpep1Δtsp1Δslp1Δgap1Δgap2Δpep4Δpep3Δpep5Δpep2Δsep1Δslp8Δamp2Δslp7

To generate a 13-fold protease deletion strain, removal of the pyr4-hph double marker was applied to the 12-fold deletion strain M893 (59-6A, pTTv327 in M780) as described above. Consecutive 5-FOA selection steps were carried out to ensure that the clones selected were originating from single cells.

Final clones were verified by PCR using the primers listed in Table 5-1. Signal corresponding to successful removal of the blaster cassette was obtained for majority of the clones. Removal of the blaster cassette was further verified by plating the clones onto minimal medium plates with or without 5 mM uridine. In addition, clones were tested also on hygromycin plates with or without 5 mM uridine. No growth was observed on the plates without uridine supplementation or if plates contained hygromycin. Resulting marker-free strain used in generation of 13-fold protease deletion strain was designated with strain number M901 (clone 1A2).

To remove vector sequence, plasmid pTTv329 (Δslp7-pyr4-hph) was digested with MssI+SbfI and the correct fragment purified from an agarose gel. Approximately 10 µg of the deletion cassette was used to transform 12-fold protease deletion strain M901 (Δpep1Δtsp1 Δslp1Δgap1Δgap2Δpep4Δpep3Δpep5Δpep2Δsep1 Δslp8Δamp2, pyr4-, hph-). Preparation of protoplasts was carried out as above. Transformation was carried out using modified transformation method for protoplasts. In this method DNA was introduced to the protoplasts as described above but media and method for plating was changed. Transformation plates and first top agar were potato dextrose agar medium containing 1 M sorbitol for osmotic stabilisation. Protoplasts were added to the first top agar, mixed, poured onto the PD agar plates and let to regenerate for a few (2-4) hours at room temperature. After the short regeneration, a second top agar containing 10 g/l sorbose, 10 g/l cellobiose, 10 g/l yeast extract, 1 M sorbitol, 5 g/l (NH4)2SO4 (+agar & salts) and 150 µg/ml Hygromycin B was poured on top of the first top agar.

Transformants were picked as first streaks. Growing streaks were screened by PCR (using the primers listed in Table 5-1) for correct integration. Clones giving the expected signals were purified to single cell clones and rescreened by PCR using the primers listed in Table 5-1.

TABLE 5-1

Primers for screening removal of pyr4-hph blaster cassette from 12-fold protease deletion strain and for screening pTTv329/ Δslp7-pyr4-hph integration and strain purity.

| Primer | Sequence |
| --- | --- |
| For screening removal of pyr4-hph blaster cassette from M893 and strain purity | |
| T1556_amp2_5f_f2 | AAGTGTGCTGATGTGATGGA (SEQ ID NO: 861) |
| T1557_amp2_3f_r2 | GCATGCGAAGTACCTTACGA (SEQ ID NO: 862) |
| T061_pyr4_orf_screen_2F | TTAGGCGACCTCTTTTTCCA (SEQ ID NO: 382) |
| T624_gpdA_seqR1 | CTCCATATTCTCCGATGATGC (SEQ ID NO: 852) |
| For screening integration of pTTv329 (Δslp7-pyr4-hph) | |
| T1092_slp7_screen_5flk_fwd | TTGGTTTGAACAGCTGCAAG (SEQ ID NO: 677) |
| T488_pyr4_5utr_rev | GGAGTTGCTTTAATGTCGGG (SEQ ID NO: 428) |

TABLE 5-1-continued

Primers for screening removal of pyr4-hph blaster cassette from 12-fold protease deletion strain and for screening pTTv329/ Δslp7-pyr4-hph integration and strain purity.

| Primer | Sequence |
| --- | --- |
| T047_trpC_term_end_F | CCTATGAGTCGTTTACCCAGA (SEQ ID NO: 426) |
| T1093_slp7_screen_3flk_rev | ATGGTCAGCCAGAACCTGAC (SEQ ID NO: 680) |
| For screening deletion of slp7 ORF | |
| T1094_slp7_orf_fwd | TCTTGAGCCGTTTCTCGAAT (SEQ ID NO: 681) |
| T1095_slp7_orf_rev | CCGCTCTTAGATCGATGGTC (SEQ ID NO: 682) |

Example 6

Generation of 13-Fold Protease Deletion Strain with slp3

To generate a 13-fold protease deletion strain, removal of the pyr4-hph double marker was applied to the 12-fold deletion strain M893 as described above. Consecutive 5-FOA selection steps were carried out to ensure that the clones selected were originating from single cells.

Final clones were verified by PCR using the primers listed in Table 6-1. Signal corresponding to successful removal of the blaster cassette was obtained for majority of the clones. Removal of the blaster cassette was further verified by plating the clones onto minimal medium plates with or without 5 mM uridine. In addition, clones were tested also on hygromycin plates with or without 5 mM uridine. Resulting marker-free strain used in generation of 13-fold protease deletion strain was designated with strain number M901 (clone 1A2).

To remove vector sequence, plasmid pTTv425 (Δslp3-pyr4) was digested with MssI and the correct fragment purified from an agarose gel. Approximately 5 µg of the deletion cassette was used to transform 12-fold protease deletion strain M901 (Δpep1Δtsp1Δslp1Δgap1Δgap2Δpep4Δpep3Δpep5Δpep2Δsep1Δslp8Δamp2, pyr4-, hph-). Preparation of protoplasts and transformation were carried out as above. Transformants were picked as first streaks. Growing streaks were screened by PCR (using the primers listed in Table 6-1) for correct integration and clones giving the expected signals were purified to single cell clones and rescreened by PCR using the primers listed in Table 6-1.

TABLE 6-1

Primers for screening removal of pyr4-hph blaster cassette from 12-fold protease deletion strain and for screening pTTv425/Δslp3-pyr4 integration and strain purity.

| Primer | Sequence |
| --- | --- |
| For screening removal of pyr4-hph blaster cassette from M893 and strain purity | |
| T1556_amp2_5f_f2 | AAGTGTGCTGATGTGATGGA (SEQ ID NO: 861) |

TABLE 6-1-continued

Primers for screening removal of pyr4-hph blaster cassette from 12-fold protease deletion strain and for screening pTTv425/Δslp3-pyr4 integration and strain purity.

| Primer | Sequence |
| --- | --- |
| T1557_amp2_3f_r2 | GCATGCGAAGTACCTTACGA (SEQ ID NO: 862) |
| T061_pyr4_orf_screen_2F | TTAGGCGACCTCTTTTTCCA (SEQ ID NO: 382) |
| T624_gpdA_seqR1 | CTCCATATTCTCCGATGATGC (SEQ ID NO: 852) |
| For screening integration of pTTv425 (Δslp3-pyr4) | |
| T056_slp3_5screen_F | GTGAATGGGTGGCAACATGA (SEQ ID NO: 333) |
| T488_pyr4_5utr_rev | GGAGTTGCTTTAATGTCGGG (SEQ ID NO: 428) |
| T061_pyr4_orf_screen_2F | TTAGGCGACCTCTTTTTCCA (SEQ ID NO: 382) |
| T057_slp3_3screen_R | CATCAAGTTGACCACCATTGT (SEQ ID NO: 336) |
| For screening deletion of slp3 ORF | |
| T1581_slp3_ORF_probe2_f | AGTTAATGATGCCCGTCTTG (SEQ ID NO: 663) |
| T1582_slp3_ORF_probe2_r | GAGCGTCTCCTGTTAGCTTG (SEQ ID NO: 664) |

Example 7

Generation of 13-Fold Protease Deletion Strain with pep9

To generate a 13-fold protease deletion strain, removal of the pyr4-hph double marker was applied to the 12-fold deletion strain M893 essentially as described above. Consecutive 5-FOA selection steps were carried out to ensure that the clones selected were originating from single cells.

Final clones were verified by PCR using the primers listed in Table 7-1. Signal corresponding to successful removal of the blaster cassette was obtained for majority of the clones. Removal of the blaster cassette was further verified by plating the clones onto minimal medium plates with or without 5 mM uridine. In addition, clones were tested also on hygromycin plates with or without 5 mM uridine. Resulting marker-free strain used in generation of 13-fold protease deletion strain was designated with strain number M901 (clone 1A2).

To remove vector sequence, plasmid pTTv426 was digested with MssI and the correct fragment purified from an agarose gel. Approximately 5 μg of the deletion cassette was used to transform 12-fold protease deletion strain M901 (Δpep1Δtsp1Δslp1Δgap1 Δgap2Δpep4Δpep3Δpep5Δpep2Δsep1 Δslp8Δamp2, pyr4–, hph–). Preparation of protoplasts and transformation were carried out as above. Transformants were picked as first streaks. Growing streaks were screened by PCR (using the primers listed in Table 7-1) for correct integration and clones giving the expected signals were purified to single cell clones and rescreened by PCR using the primers listed in Table 7-1.

TABLE 7-1

Primers for screening removal of pyr4-hph blaster cassette from 12-fold protease deletion strain and for screening pTTv426/Δpep9-pyr4 integration and strain purity.

| Primer | Sequence |
| --- | --- |
| For screening removal of pyr4-hph blaster cassette from M893 and strain purity | |
| T1556_amp2_5f_f2 | AAGTGTGCTGATGTGATGGA (SEQ ID NO: 861) |
| T1557_amp2_3f_r2 | GCATGCGAAGTACCTTACGA (SEQ ID NO: 862) |
| T061_pyr4_orf_screen_2F | TTAGGCGACCTCTTTTTCCA (SEQ ID NO: 382) |
| T624_gpdA_seqR1 | CTCCATATTCTCCGATGATGC (SEQ ID NO: 852) |
| For screening integration of pTTv426 (Δpep9-pyr4) | |
| T1031_pep9_screen_5flk_fwd | GGGTTGGAGATGTTGGAAGA (SEQ ID NO: 865) |
| T488_pyr4_5utr_rev | GGAGTTGCTTTAATGTCGGG (SEQ ID NO: 428) |
| T061_pyr4_orf_screen_2F | TTAGGCGACCTCTTTTTCCA (SEQ ID NO: 382) |
| T1032_pep9_screen_3flk_rev | TTGACGAGACGGGGAGTTAC (SEQ ID NO: 866) |
| For screening deletion of pep9 ORF | |
| T1033_pep9_orf_fwd | CAGCCCTGACACCACTCTCT (SEQ ID NO: 867) |
| T1034_pep9_orf_rev | TCCAGTCCTTGGGAGAAATG (SEQ ID NO: 868) |

Example 8

Generation of 9-Fold Protease Deletion Strains from the Interferon Producing Strain M577

Generation of 9-Fold Deletion Strain with amp1 Deletion

To remove the deletion cassette, plasmid pTTv240 (Δamp1-pyr4-hph) was digested with PmeI and the correct fragment was purified using a QIAquick Gel Extraction Kit (Qiagen). Approximately 5 μg of the deletion cassette was used to transform the 8-fold protease deletion strain M577 (Δpep1Δtsp1 Δslp1Δgap1Δgap2Δpep4Δpep3Δpep5; see Example 18 of WO2013/102674), which produces interferon alpha 2b. Preparation of protoplasts and transformation were carried out essentially as described above using hygromycin selection. Transformants were picked and streaked on selection plates. Growing streaks were screened by PCR (using the primers listed in Table 8-1) for correct integration. Transformants giving the expected signals were purified to single cell clones and rescreened by PCR using the primers listed in Table 8-1. The clone 108A was designated with strain number M669.

TABLE 8-1

Primers for screening pTTv240/Δamp1-pyr4-hgh integration and strain purity.

| Primer | Sequence |
|---|---|
| *For screening integration of pTTv240 (Δamp1-pyr4-hph)* | |
| T840_amp1_screen_5 flk fwd | TGGCATTGATCTAGAACCTCCT (SEQ ID NO: 869) |
| T1084_screen_5flk_pyr_rev | TCTTGAGCACGACAATCGAC (SEQ ID NO: 662) |
| T1015_screen_3flk_hygro_fwd | GCATGGTTGCCTAGTGAATG (SEQ ID NO: 663) |
| T843_amp1_scrn_rev 3 flk | GACGACTTGGTGGAGCTCAT (SEQ ID NO: 870) |
| *For screening deletion of amp1 ORF* | |
| T940_amp1_orf2_fw | GACTACCCCCAGAACGTCAA (SEQ ID NO: 871) |
| T941_amp1_orf2_rev | AAGAGGCGGATCTTTTGGTT (SEQ ID NO: 872) |

Generation of 9-Fold Deletion Strain with slp7 Deletion

The deletion plasmid pTTv269 for the serine protease slp7 (tre123865) is described in Example 11 of WO2013/102674.

To remove the deletion cassette, plasmid pTTv269 (Δslp7-pyr4-hph) was digested with PmeI and the correct fragment was purified using a QIAquick Gel Extraction Kit (Qiagen). Approximately 5 µg of the deletion cassette was used to transform the 8-fold protease deletion strain M577 (Δpep1Δtsp1 Δslp1Δgap1Δgap2Δpep4Δpep3Δpep5 see above). Preparation of protoplasts and transformation were carried out essentially as described above using hygromycin selection.

Transformants were picked and streaked on selection plates. Growing streaks were screened by PCR (using the primers listed in Table 8-2) for correct integration. Transformants giving the expected signals were purified to single cell clones and rescreened by PCR using the primers listed in Table 8-2. The clone 5.64 was designated with strain number M673.

TABLE 8-2

Primers for screening pTTv269/Δslp7-pyr4-hgh integration and strain purity.

| Primer | Sequence |
|---|---|
| *For screening integration of pTTv269 (Δslp7-pyr4-hgh)* | |
| T1092_slp7_screen_5flk_fwd | TTGGTTTGAACAGCTGCAAG (SEQ ID NO: 677) |
| T1084_screen_5flk_pyr_rev | TCTTGAGCACGACAATCGAC (SEQ ID NO: 662) |
| T1015_screen_3flk_hygro_fwd | GCATGGTTGCCTAGTGAATG (SEQ ID NO: 663) |
| T1093_slp7_screen_3flk_rev | ATGGTCAGCCAGAACCTGAC (SEQ ID NO: 680) |

TABLE 8-2-continued

Primers for screening pTTv269/Δslp7-pyr4-hgh integration and strain purity.

| Primer | Sequence |
|---|---|
| *For screening deletion of slp7 ORF* | |
| T1094_slp7_orf_fwd | TCTTGAGCCGTTTCTCGAAT (SEQ ID NO: 681) |
| T1095_slp7_orf_rev | CCGCTCTTAGATCGATGGTC (SEQ ID NO: 682) |

Generation of 9-Fold Deletion Strain with amp2 Deletion

To remove the deletion cassette, plasmid pTTv271 (Δamp2-pyr4-hgh) was digested with PmeI and the correct fragment was purified using a QIAquick Gel Extraction Kit (Qiagen). Approximately 5 µg of the deletion cassette was used to transform the 8-fold protease deletion strain M577.

Transformants were picked and streaked on selection plates. Growing streaks were screened by PCR (using the primers listed in Table 8-3) for correct integration. Transformants giving the expected signals were purified to single cell clones and rescreened by PCR using the primers listed in Table 8-3. Clone 24A was designated with strain number M674.

TABLE 8-3

Primers for screening pTTv271/Δamp2-pyr4-hgh integration and strain purity.

| Primer | Sequence |
|---|---|
| *For screening integration of pTTv271 (Δamp2-pyr4-hph)* | |
| T1083_amp2_screen_5flk_fwd | CCACTGAAGGGGAGTTTTCA (SEQ ID NO: 857) |
| T1084_screen_5flk_pyr_rev | TCTTGAGCACGACAATCGAC (SEQ ID NO: 662) |
| T1015_screen_3flk_hygro_fwd | GCATGGTTGCCTAGTGAATG (SEQ ID NO: 663) |
| T1085_amp2_screen_3flk_rev | TCGCGGTATCGTATGAGATG (SEQ ID NO: 858) |
| *For screening deletion of amp2 ORF* | |
| T1086_amp2_orf_fwd | GCCAGCTTCAACATCGACTT (SEQ ID NO: 859) |
| T1087_amp2_orf_rev | CAGCACGAGCACGTTGTACT (SEQ ID NO: 860) |

Generation of 9-Fold Deletion Strain with sep1 Deletion

To remove the deletion cassette, plasmid pTTv247 (Δsep1-pyr4-hgh) was digested with PmeI and the correct fragment was purified using a QIAquick Gel Extraction Kit (Qiagen). Approximately 5 µg of the deletion cassette was used to transform the 8-fold protease deletion strain M577.

Transformants were picked and streaked on selection plates. Growing streaks were screened by PCR (using the primers listed in Table 8-4) for correct integration. Clones giving the expected signals were purified to single cell clones and rescreened by PCR using the primers listed in Table 8-4. Clone 47.1 was designated with strain number M668.

TABLE 8-4

Primers for screening pTTv247/Δsep1-pyr4-hgh integration and strain purity.

| Primer | Sequence |
|---|---|
| *For screening integration of pTTv247 (Δsep1-pyr4-hgh)* | |
| T519_serendo_5int | AACCACCTTGTTCTGTCCGT (SEQ ID NO: 842) |
| T488_pyr4_5utr_rev | GGAGTTGCTTTAATGTCGGG (SEQ ID NO: 428) |
| T521_serendo_3int | GGAACTGTCAAGATCTGGGA (SEQ ID NO: 843) |
| T1015_screen_3flk_hygro_fwd | GCATGGTTGCCTAGTGAATG (SEQ ID NO: 663) |
| *For screening deletion of sep1 ORF* | |
| T504_serendo_orf_probef | GCCTCCGCCCTCCTCTTCCA (SEQ ID NO: 873) |
| T505_serendo_orf_prober | GCTTTGTCGAGCGGAGCGGT (SEQ ID NO: 874) |

Generation of 9-Fold Deletion Strain with pep9 Deletion

To remove the deletion cassette, plasmid pTTv267 (Δpep9-pyr4-hgh) was digested with PmeI and the correct fragment was purified using a QIAquick Gel Extraction Kit (Qiagen). Approximately 5 µg of the deletion cassette was used to transform the 8-fold protease deletion strain M577.

Transformants were picked and streaked on selection plates. Growing streaks were screened by PCR (using the primers listed in Table 8-5) for correct integration. Clones giving the expected signals were purified to single cell clones and rescreened by PCR using the primers listed in Table 8-5. Transformant 77 was designated with strain number M671.

TABLE 8-5

Primers for screening pTTv267/Δpep9-pyr4-hgh integration and strain purity.

| Primer | Sequence |
|---|---|
| *For screening integration of pTTv267 (Δpep9-pyr4-hgh)* | |
| T1031_pep9_screen_5flk_fwd | GGGTTGGAGATGTTGGAAGA (SEQ ID NO: 865) |
| T1084_screen_5flk_pyr_rev | TCTT GAGCACGACAATCGAC (SEQ ID NO: 662) |
| T1015_screen_3flk_hygro_fwd | GCATGGTTGCCTAGTGAATG (SEQ ID NO: 663) |
| T1032_pep9_screen_3flk_rev | TTGACGAGACGGGGAGTTAC (SEQ ID NO: 866) |
| *For screening deletion of pep9 ORF* | |
| T1033_pep9_orf_fwd | CAGCCCTGACACCACTCTCT (SEQ ID NO: 867) |
| T1034_pep9_orf_rev | TCCAGTCCTTGGGAGAAATG (SEQ ID NO: 868) |

Example 9

9-Fold Protease Deletion Strains Producing Interferon in 24 Well Culture

The 9-fold protease deletion strains were grown in 24 well culture in TrMM with diammonium citrate without ammonium sulfate, 100 mM PIPPS, 20 g/L spent grain extract, 40 g/L lactose at pH 4.5, shaking at 28° C. Immunoblotting was done to detect interferon alpha 2b. The supernatant was diluted with water, so that 0.5 µl of each supernatant could be loaded into the 4-20% Criterion gel. Mixed with LSB+BME and heated at 95° C. for 5 minutes. The proteins were transferred to nitrocellulose with the Turbo semi-dry blotter for 7 minutes. The nitrocellulose membrane was blocked with 5% milk in TBST for 1 hour. The interferon protein was detected with a mouse anti-interferon alpha 2b antibody (Abcam #ab9386) diluted 0.5 µg/ml in TBST. The primary antibody was incubated with the membrane for 1 hour shaking at room temperature. The primary antibody was removed and the membrane washed with TBST. The secondary antibody was goat anti-mouse AP conjugate (BioRad cat#170-6520) diluted 1:10,000 in TBST. The secondary antibody was incubated for 1 hour shaking at room temperature, the antibody was removed, and membrane washed for 1 hour shaking at room temperature. The blot was developed using AP substrate (Promega).

Figure 4:
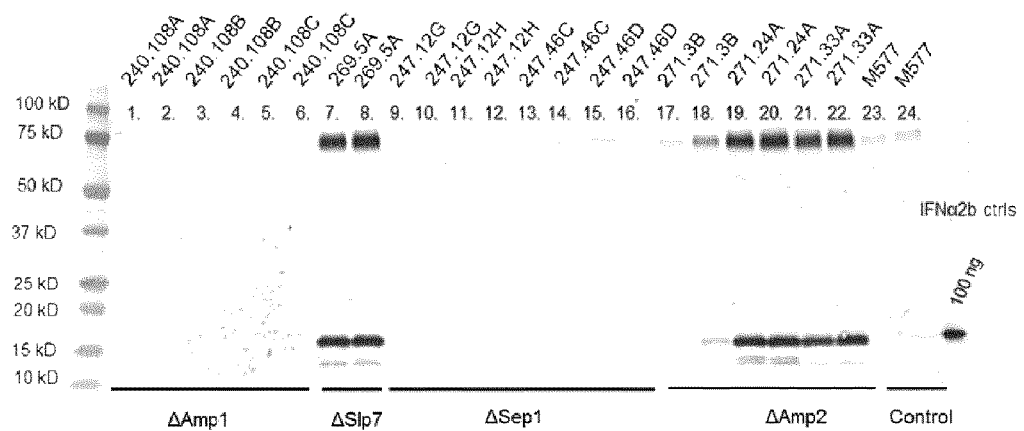
FIG. 4 depicts 24 well culture of 9 fold protease deletion strains. Cultures were grown in TrMM with diammonium citrate without ammonium sulfate, 100 mM PIPPS, 20 g/L spent grain extract, 40 g/L lactose at pH 4.5, shaking at 28° C. Immunoblot of interferon alpha 2b expression from 0.5 μl culture supernatant.

Observing the day 7 culture samples there was a dramatic effect on the stability of interferon. The slp7 and amp2 deletion strains continued to produce interferon, while interferon was not stable in the M577 control and the amp1 and sep1 deletion strains. Results are shown in FIG. 4.

Example 10

9-Fold Protease Deletion Strains Producing Interferon in Fermentor Culture

The 9-fold protease deletion strains expressing interferon were cultivated in fermentors as batch cultivations. They were grown in TrMM plus in 20 g/L yeast extract, 40 g/L cellulose, 80 g/L cellobiose, and 40 g/L sorbose at pH 4.5 with the temperature shifting from 28° to 22° at 48h. These cultivations were done and assigned the culture codes FTR108_R1 (M668), FTR108_R2 (M669), FTR108_R6 (M673), and FTR108_R7 (M674).

The supernatant was diluted in water and sample buffer so that 0.1 µl could be loaded per well. The immunoblotting procedure to detect interferon alpha 2b was carried out as described above with the 24 well cultures.

Figure 5:
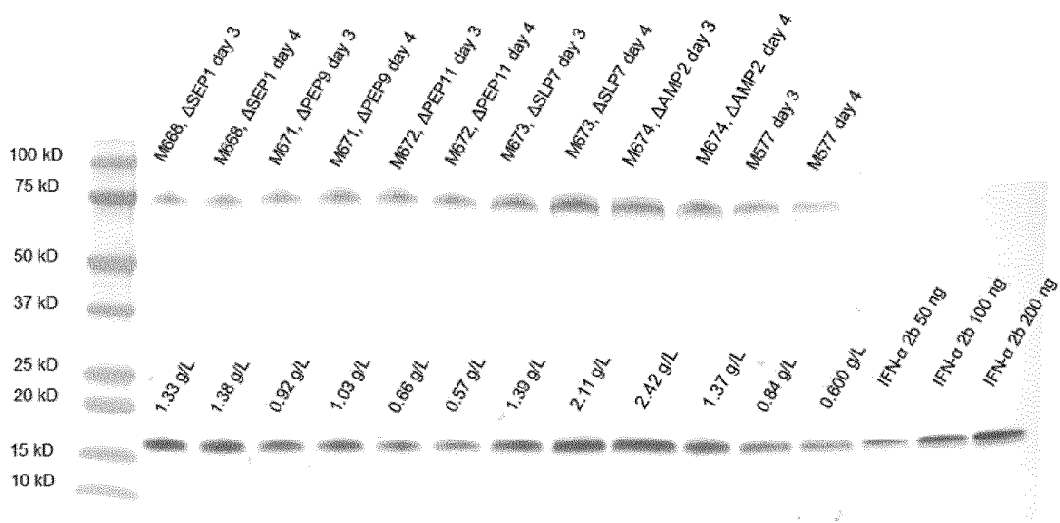
FIG. 5 depicts a fermentor cultivation of 9 protease deletion strains expressing interferon. Strains were grown in TrMM plus 20 g/L yeast extract, 40 g/L cellulose, 80 g/L cellobiose, 40 g/L sorbose, pH 4.5. Immunoblot detecting interferon alpha 2b from 0.1 μl of supernatant. Standard amounts of interferon 50, 100, and 200 ng were used to generate a standard curve.

The results of the fermentor cultivations can be seen in FIG. 5. Standard amounts representing 50, 100, and 200 ng of interferon were used to generate a standard curve. The parental M577 control cultivation produced 0.84 g/L of interferon on day 3. The M674 strain with the amp2 protease deletion was the most improved strain overall providing 2.4 g/L on day 3. Deletion of amp2 protease provided a 2.9 fold improvement in interferon production. The slp7 protease deletion strain M673 achieved 2.1 g/L on day 4. This was a 2.5 fold improvement over the parent strain M577. The sep1 protease deletion in M668 secreted 1.38 g/L of interferon.

The pep9 deletion in strain M671 also improved the interferon expression level to 1.03 g/L. The M669 strain with amp1 deletion produced 0.36 g/L under these culture conditions (data not shown).

The strain M674 (Δamp2) was also cultivated with and without SBTI inhibitor addition. The medium was TrMM plus 20 g/L yeast extract, 40 g/L cellulose, 80 g/L cellobiose, and 40 g/L sorbose at pH 4.5 with the temperature shifting from 28° to 22° at 48h. The Triab 125 cultivation was done without SBTI inhibitor and Triab 126 was done with SBTI inhibitor feeding (0.4 mg/ml target concentration).

Figure 6:
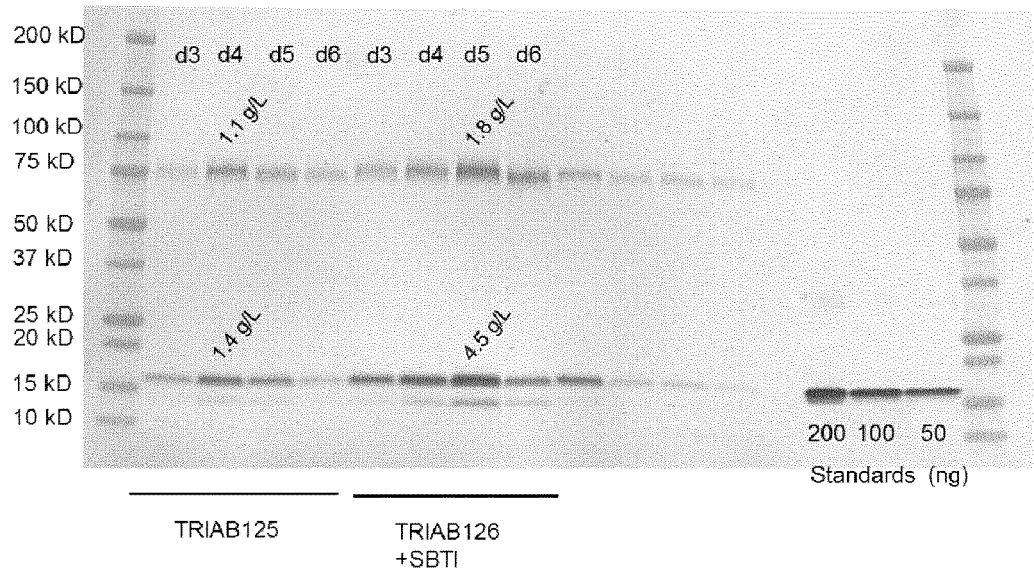
FIG. 6 depicts an immunoblot showing the interferon alpha 2b production level in the supernatant of the M674 cultivated in the Triab125 and Triab126 fermentations

The SBTI inhibitor improved the interferon expression level, see FIG. 6. The base level was 1.4 g/L on day 4, but with inhibitor treatment the interferon expression could be increased to 4.5 g/L on day 5. The addition of inhibitor shifted the peak expression day until day 5, which indicated higher stability of the interferon in the supernatant.

The supernatant was diluted in water so that 0.025 µl could be loaded in 10 µl volume into a 4-20% SDS-PAGE gel Immunodetection done with Abcam (#ab9386) anti-IFN-α 2b antibody diluted to 1 µg/ml in TBST. The secondary antibody from Bio-rad (#170-6520) goat anti-mouse IgG AP conjugated secondary antibody diluted 1:5000 in TBST. The protein standards were loaded in the gel corresponding 200 ng, 100 ng, and 50 ng of full length IFN-α 2b.

Example 11

Generation of 9-Fold Protease Deletion Strain M960 with pep2 Deletion and slp2 RNAi from the Interferon Producing Strain M788 (pyr4− of M577)

The interferon production strain M577 had the pyr4 marker in the pep5 locus, where the last protease deletion was made. To remove the pyr4 loopout marker, the M577 strain was plated on 5FOA plates. The surviving colonies were screened by PCR to check the presence and integration of the pyr4 marker. The clones that did not have the double marker by PCR were tested on minimum medium agar plates with and without uridine. Those clones that could not grow on plates without uridine were selected as marker loopout clones. One pyr4− negative clone was selected to become strain M788. Primers used in the screening are shown below in table 11-1.

TABLE 11-1

| For screening integration of pyr4-hgh marker | |
|---|---|
| Primer | Sequence |
| T627_pep5_5int_new | GTCGAAGATGTCCTCGAGAT (SEQ ID NO: 432) |
| T488_pyr4_5utr_rev | GGAGTTGCTTTAATGTCGGG (SEQ ID NO: 428) |
| T061_pyr4_orf_screen_2F | TTAGGCGACCTCTTTTTCCA (SEQ ID NO: 382) |
| T628_pep5_3int_new | TAGTCCATGCCGAACTGC (SEQ ID NO: 435) |
| For screening deletion of marker | |
| T858_pep5_5f_f3 | GGAATCGTCACCAAGGAG (SEQ ID NO: 612) |
| T755_pep5_3f_rev3 | CTTCTGGTGACATTCCGAC (SEQ ID NO: 613) |

To remove the deletion cassette, the plasmids were digested with PmeI and the correct fragment was purified using a QIAquick Gel Extraction Kit (Qiagen). Approximately 5 µg of the deletion cassette was used to transform the 8-fold protease deletion strain M788 (Δpep1Δtsp1Δslp1Δgap1Δgap2Δpep4Δpep3Δpep5, pyr4−), which produces interferon alpha 2b. Preparation of protoplasts and transformation were carried out essentially as described above. The silencing cassettes were designed to integrate into the pep2 locus (tre53961).

Transformants were picked and streaked on selection plates. Growing streaks were screened by PCR (using the primers listed in Table 11-2) for correct integration. Clones giving the expected signals were purified to single cell clones and rescreened by PCR using the primers listed in Table 11-2. The transformation of pTTv376 produced a strain designated as M960 and pTTv405 produced the M961 strain.

TABLE 11-2

| Primers for screening pTTv376 and pTTv405/Δpep2-pyr4-hgh integration and strain purity. | |
|---|---|
| For screening integration of pTTv376 and pTTv405 (Δpep2-pyr4-hgh) | |
| Primer | Sequence |
| T596_pep2_fwd 5'flank_screen | CCTCTGCGTTGAGCAACATA (SEQ ID NO: 614) |
| T624_gpdA_seqR1 | CTCCATATTCTCCGATGATGC (SEQ ID NO: 852) |

TABLE 11-2-continued

Primers for screening pTTv376 and pTTv405/Δpep2-pyr4-hgh integration and strain purity.

| | |
|---|---|
| T600_pep2 rev 3'flank screen | CGAAAGCGTGGAGTCTTCTC (SEQ ID NO: 615) |
| T047_trpC_term_end_F | CCTATGAGTCGTTTACCCAGA (SEQ ID NO: 426) |
| For screening deletion of pep2 ORF | |
| T601_pep2 fwd | GACGTGGTACGACAACATCG (SEQ ID NO: 269) |
| T623_pep2 rev | TATCAAGGTACCGGGGACAG (SEQ ID NO: 270) |

Culturing in 24 well plates

Two transformants from the pTTv376 and pTTv405 transformations were grown in 24 well cultures to compare their interferon production against the control strain M577. The strains were grown in TrMM with diammonium citrate without ammonium sulfate, 100 mM PIPPS, 20 g/L spent grain extract, 40 g/L lactose at pH 4.5, shaking at 28° C. Duplicate wells were used for each transformant. Samples from the 24 well cultures taken on day 5 were used for immunoblotting. The supernatant was diluted with water, so that 0.2 µl of each supernatant could be loaded into the 4-20% Criterion gel. Mixed with LSB+BME and heated at 95° C. for 5 minutes. The proteins were transferred to nitrocellulose with the BioRad Turbo semi-dry blotter for 7 minutes. The nitrocellulose membrane was blocked with 5% milk in TBST for 1 hour. The interferon protein was detected with a mouse anti-interferon alpha 2b antibody (Abcam #ab9386) diluted 0.5 µg/ml in TBST. The primary antibody was incubated with the membrane for 1 hour shaking at room temperature. The primary antibody was removed and the membrane washed with TBST. The secondary antibody goat anti-mouse IRDye 680RD conjugate (Li-cor #926-68070) diluted 1:30,000 in TBST. The secondary antibody was incubated for 1 hour shaking at room temperature. The secondary antibody was removed and membrane washed for 1 hour in TBST before scanning the membrane. The membrane was scanned at 700 nm using the Odyssey CLx near infrared imaging system (Li-cor, Inc.).

Figure 7:
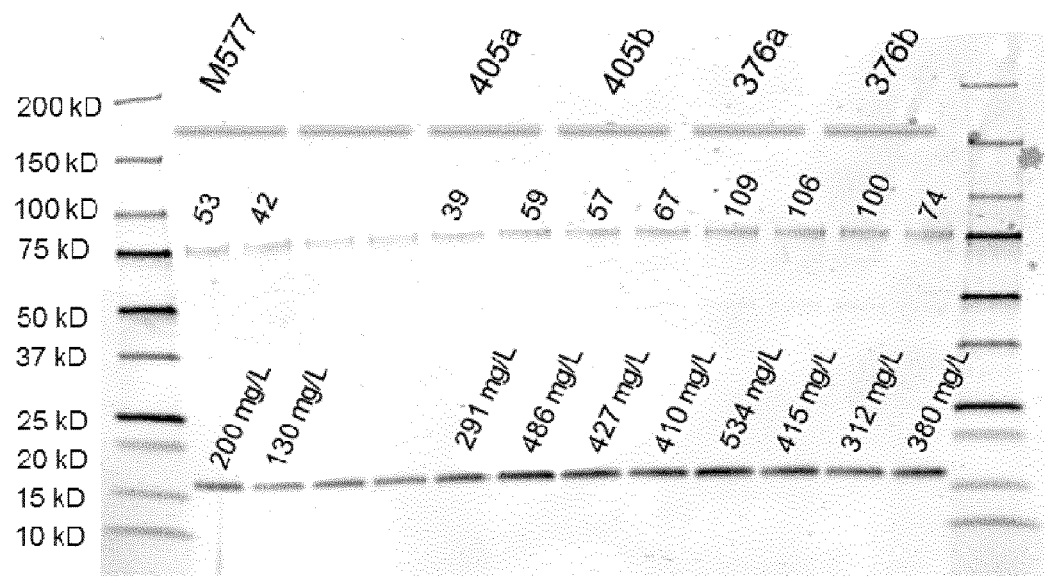
FIG. 7 depicts a 24 well culture of slp2 silencing strains and control M577 strain. Cultures were grown in TrMM with diammonium citrate without ammonium sulfate, 100 mM PIPPS, 20 g/L spent grain extract, 40 g/L lactose at pH 4.5, shaking at 28° C. Immunoblot of interferon alpha 2b expression from 0.2 μl culture supernatant.

The 24 well cultivation results can be seen in FIG. 7. Both strains with slp2 silencing produced high amounts of interferon. The best pTTv405 transformant 405b produced 427 mg/L of interferon which was assigned strain number M960. The best pTTv376 transformant 376a produced up to 534 mg/L of interferon and was called strain M961. The control strain (M577) reached up to 200 mg/L. The M961 strain produced 2.7 times more interferon in this cultivation and 2.1 times more with M960 compared to control strain, respectively.

Fermentation

The two strains were cultivated in 1 L fermentors as batch cultures in TrMM in 20 g/L yeast extract, 40 g/L cellulose, 80 g/L cellobiose, and 40 g/L sorbose at pH 4.5 with the temperature shifting from 28° to 22° at 48h. Triab152 and Triab153 cultivations were done with strains M960 and M961, respectively. The supernatant samples were diluted in water and loading dye so that 0.05 µl of supernatant was loaded per well Immunoblotting for detection was done as described above for interferon. Standard amounts of interferon representing 400, 200. 100, 50 and 25 ng were used to construct a standard curve to determine expressed concentration.

Figure 8:
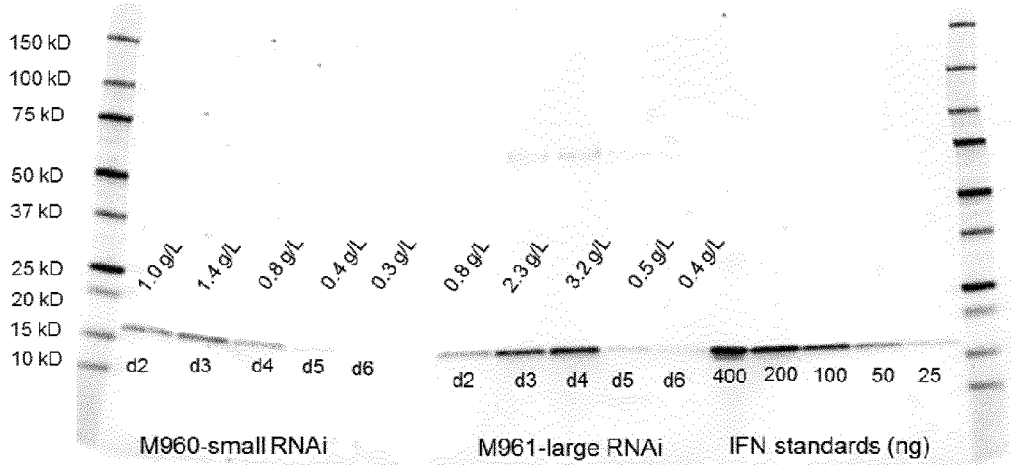
FIG. 8 depicts cultivation of strains M960 and M961 in fermentor using TrMM in 20 g/L yeast extract, 40 g/L cellulose, 80 g/L cellobiose, and 40 g/L sorbose at pH 4.5 with the temperature shifting from 28° to 22° at 48 h. Immunoblot detecting interferon alpha 2b from 0.05 μl of supernatant. Interferon standards were 400, 200, 100, 50, and 25 ng.

In cultivation Triab152 the M960 strain produced 1.4 g/L on day 3 (FIG. 8) and the M577 strain produced 1.2 g/L on day 3 (data not shown). The strain M961 achieved 3.2 g/L on day 4 which was 2.7 times more interferon than the parental strain M577.

Example 12

Introduction of Heterologous Proteins into the Protease Deletion Strains

To generate the MAB01 antibody producing *T. reesei* strain in any of the protease deleted strain(s) of the invention a strain is transformed with MAB01 light and heavy chain constructs (pTTv98, pTTv99, pTTv67, pTTv101, pTTv102, and/or pTTv223, see also Examples 1-3 of WO2013/102674) using hygromycin and acetamide in selection as described above. To produce rituximab antibody, constructs having harmonised heavy chain fused with CBHI carrier and light chain fused with CBHI carrier are transformed to protease deletion strains of *T. reesei* as described above.

To express various antibody fragments (Fabs, multimeric single domain antibodies (sd-Ab's) and scFVs) in different protease deletion backgrounds of the invention methods of Example 23 are applicable. The architecture of the genetic expression cassettes applied for this purpose is usually based on the regulatory elements (promoter and terminator) of the cellobiohydrolase I (cbh1) gene. The catalytic domain of the CBHI protein is modified to remove intron sequences and used as fusion partner to enhance antibody fragment expression and secretion. A recognition motif for the Kex2 protease is inserted in between the fusion partners to promoter co-secretory release of the antibody fragments from the CBHI carrier protein and the expression cassettes are flanked by homologous regions to allow targeted integration to the *T. reesei* cbh1 locus.

*T. reesei* protease deletion strains are transformed with the purified expression cassettes as described and selected for appropriate selection marker. Transformants are screened by PCR for homologous integration of the expression cassette to the cbh1 locus using a forward primer outside the 5' flanking region fragment of the construct and the reverse primer inside the modified CBHI catalytic domain (5' integration) as well as a forward primer inside the selection marker gene(s), respectively, and a reverse primer outside the 3' flanking region fragment (3' integration). Proper integration of the disruption cassette is reconfirmed by PCR using the same primer combinations as described above and the absence of the parental CBHI locus is verified by using a primer combination targeted to the cbh1 open reading frame. Correct integration of the disruption cassette is additionally verified for all clones applying Southern hybridization.

Transformed *T. reesei* strains are cultivated in fermentation and shake flask conditions as described earlier. Samples are collected in the course of the cultivations, and production levels are analysed, for example, by affinity liquid chromatography as described above. The quality of the purified samples is checked by SDS-PAGE.

Example 13

Glycoengineering of the Protease Deletion Strains

Generation of G0 Producing Strains

The generation of alg3 deletion plasmids pTTg156 (human full length GnT1 and human full length GnT2) and pTTg173 (Kre2 N-terminal fusion with catalytic domain of human GnT1 and full length human GnT2) are described in Example 19 of WO2013/102674.

A *T. reesei* MAB01 expression strain is transformed with the PmeI fragments of pTTg156 and pTTg173. Variable amount of transformants (100-170 depending on the construct) are picked onto selective plates and on the basis of PCR screening clones with positive results concerning 5'- and 3'-integration are selected for single spore platings and re-screening for integration and alg3 deletion using primers as described in Table 19.3 of Example 19 of WO2013/102674. PCR-screened strains are subjected to shake flask and fermentation cultivations, samples are obtained in appropriate days and the samples are subjected to antibody concentration and glycan analyses.

Generation of GlcNacMan5 Producing Strains

The generation of plasmids for fusion proteins of targeting peptide and catalytic domain of human GnT1 plasmids pTTv274 (N-terminal portion of human GnT2), pTTv275 (N-terminal portion of *T. reesei* Kre2), and pTTv278 (N-terminal portion of *T. reesei* Och1) are described in Example 21 of WO2013/102674.

Fragments for transformations are released from the above plasmids with PmeI. All fragments are transformed individually to a MAB01 (or an antibody such as rituximab) expressing strain and protoplast transformations are carried out essentially as described above.

Well growing clones on selective streaks are screened for the 5' and 3' integration into the egl2 locus. Double integration-positive clones are additionally screened for the loss of the egl2 ORF. The clones giving the desired results are purified through single spore platings, and the single spore-derived clones are verified by PCR to be pure integration strains. Selected strains are subjected to shake flask and fermentation cultivations, samples are obtained in appropriate days and the samples are subjected to antibody concentration and glycan analyses.

For N-glycan analysis MAB01 is purified from culture supernatants using Protein G HP MultiTrap 96-well filter plate (GE Healthcare) according to manufacturer's instructions and the antibody concentrations are determined via UV absorbance against MAB01 standard curve. N-glycans are released from EtOH precipitated and SDS denatured antibody using PNGase F (ProZyme Inc.) in 20 mM sodium phosphate buffer, pH 7.3, in overnight reaction at +37° C. The released N-glycans are purified with Hypersep C-18 and Hypersep Hypercarb (Thermo Scientific) and analysed with MALDI-TOF MS.

Example 14

Protease Homologs

*T. reesei* sep1, amp1, amp2, and pep9 homologs were identified from other organisms.

BLAST searches were conducted using the National Center for Biotechnology Information (NCBI) non-redundant amino acid database using the *Trichoderma reesei* protease amino acid sequences as queries. *Trichoderma virens* and *Trichoderma atroviride* BLAST searches were conducted using the DOE Joint Genome Institute's web site (*Trichoderma virens* Gv29-8 v2.0 and *Trichoderma atroviride* v2.0, respectively). Sequence hits from the BLAST searches were aligned using the ClustalW2 or Clustal Omega alignment tool provided by EBI. Phylogenetic trees were also generated using the sequence alignments.

Figure 9:
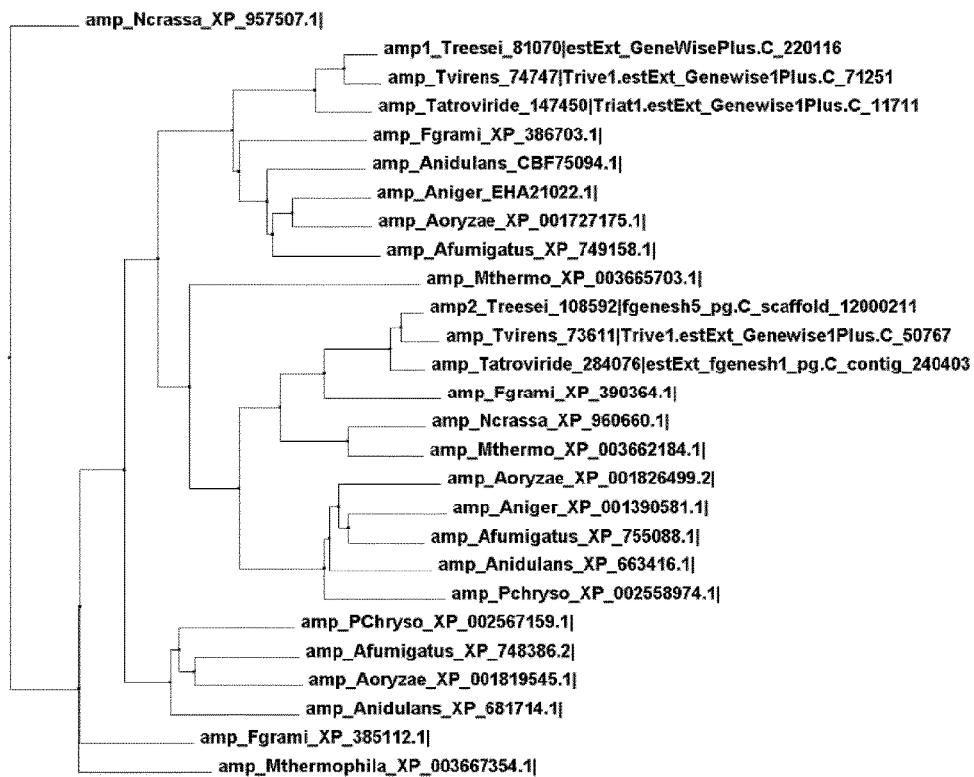
FIG. 9 depicts a phylogenetic tree of amp1 and amp2 of selected filamentous fungi.

FIG. 9 depicts a phylogenetic tree of amp1 and amp2 of selected filamentous fungi.

Figure 10:
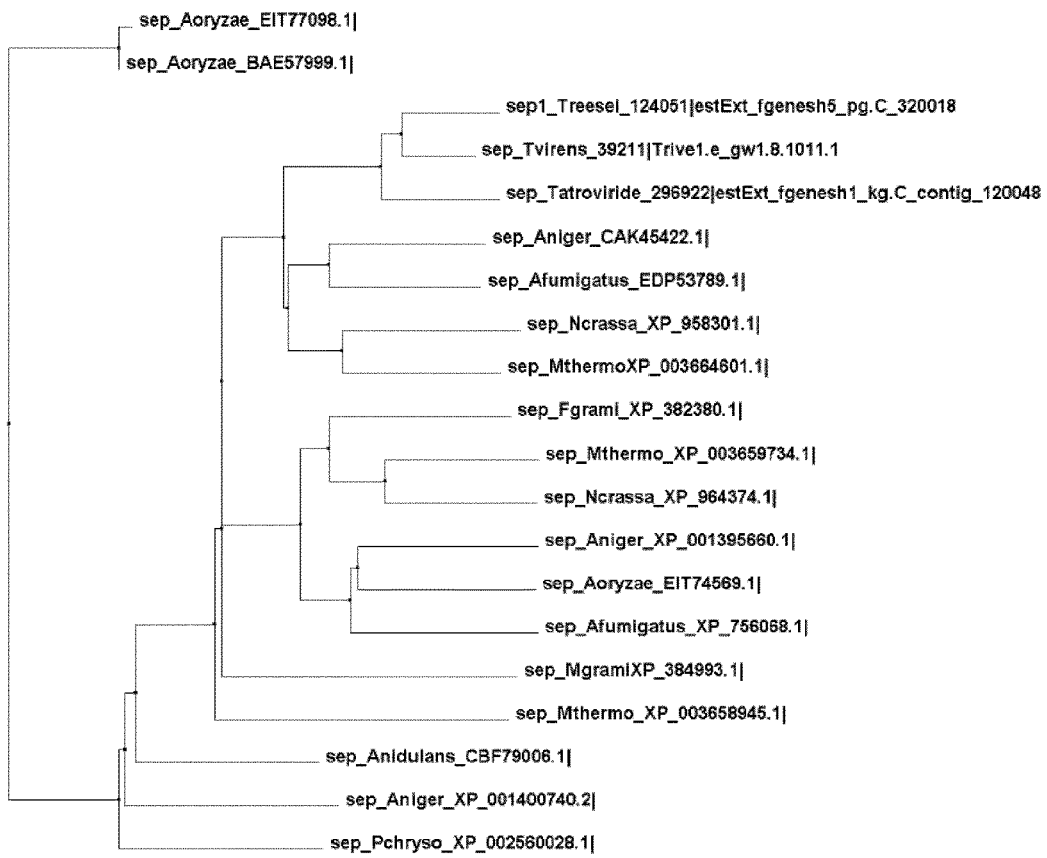
FIG. 10 depicts a phylogenetic tree of sep1 of selected filamentous fungi.

FIG. 10 depicts a phylogenetic tree of sep1 of selected filamentous fungi.

Figure 11:
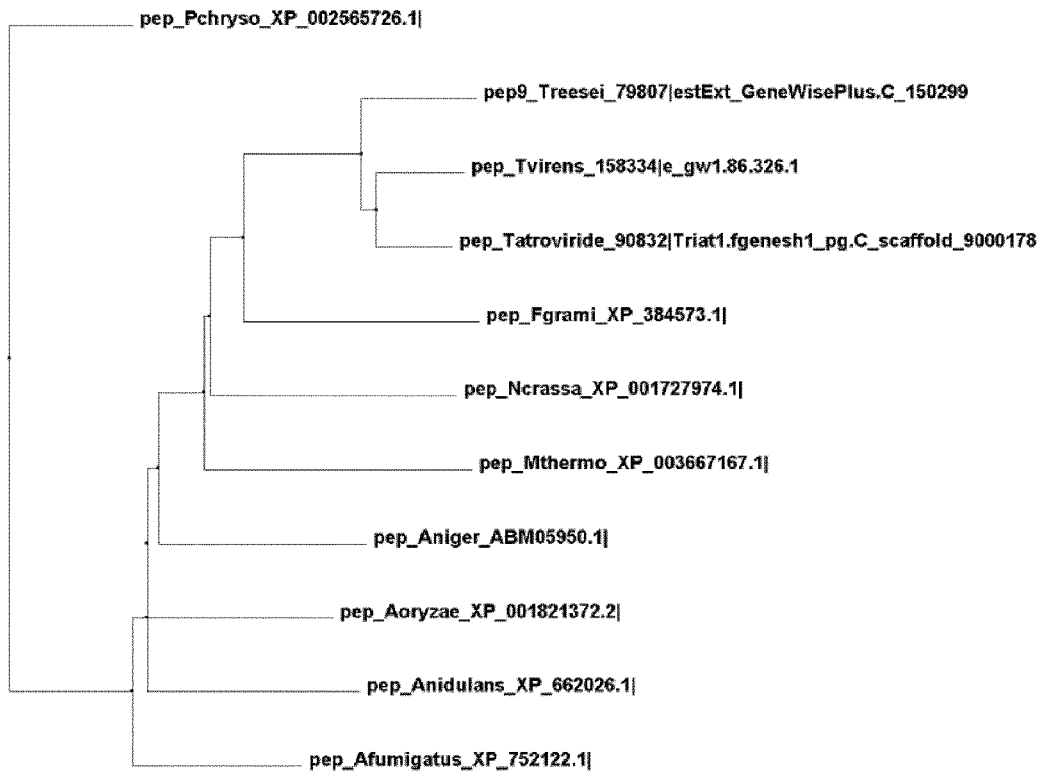
FIG. 11 depicts a phylogenetic tree of pep9 of selected filamentous fungi.

FIG. 11 depicts a phylogenetic tree of pep9 of selected filamentous fungi.

Example 15

Protease Activity Measurement of Protease Deficient *T. reesei* Strains

The protein concentrations were determined from supernatant samples from day 2-7 of 1x-7x protease deficient strains according to EnzChek protease assay kit (Molecular probes #E6638, green fluorescent casein substrate). Briefly, the supernatants were diluted in sodium citrate buffer to equal total protein concentration and equal amounts of the diluted supernatants were added into a black 96 well plate, using 3 replicate wells per sample. Casein FL diluted stock made in sodium citrate buffer was added to each supernatant containing well and the plates were incubated covered in plastic bag at 37° C. The fluorescence from the wells was measured after 2, 3, and 4 hours. The readings were done on the Varioskan fluorescent plate reader using 485 nm excitation and 530 nm emission. Some protease activity measurements were performed using succinylated casein (Quanti-Cleave protease assay kit, Pierce #23263) according to the manufacturer's protocol.

The pep1 single deletion reduced the protease activity by 1.7-fold, the pep1/tsp1 double deletion reduced the protease activity by 2-fold, the pep1/tsp1/slp1 triple deletion reduced the protease activity by 3.2-fold, the pep1/tsp1/slp1/gap1 quadruple deletion reduced the protease activity by 7.8-fold compared to the wild type M124 strain, the pep1/tsp1/slp1/gap1/gap2 5-fold deletion reduced the protease activity by 10-fold, the pep1/tsp1/slp1/gap1/gap2/pep4 6-fold deletion reduced the protease activity by 15.9-fold, and the pep1/tsp1/slp1/gap1/gap2/pep4/pep3 7-fold deletion reduced the protease activity by 18.2-fold.

Figure 20:
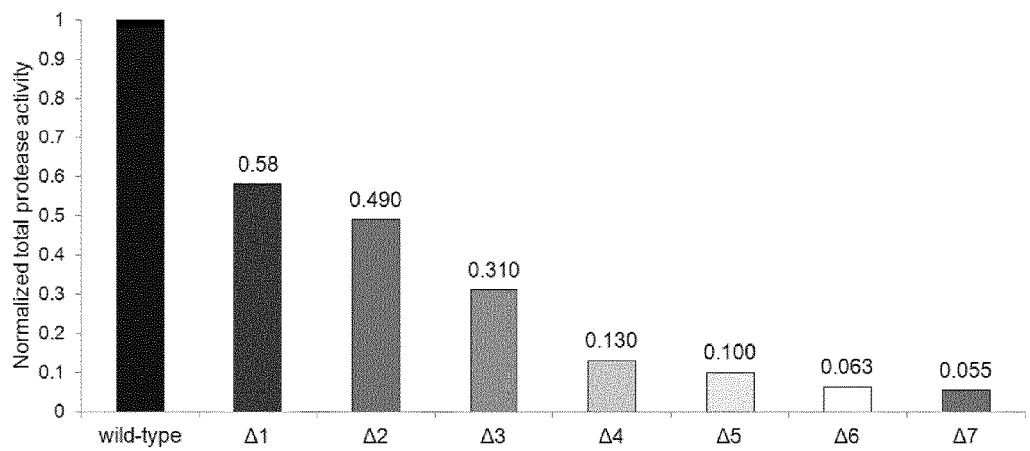
FIG. 20 graphically depicts normalized protease activity data from culture supernatants from each of the protease deletion supernatants and the parent strain M124. Protease activity was measured at pH 5.5 in first 5 strains and at pH 4.5 in the last three deletion strains. Protease activity is against green fluorescent casein. The six protease deletion strain has only 6% of the wild type parent strain and the 7 protease deletion strain protease activity was about 40% less than the 6 protease deletion strain activity.

The FIG. 20 graphically depicts normalized protease activity data from culture supernatants from each of the protease deletion supernatants (from 1-fold to 7-fold deletion mutant) and the parent strain M124. Protease activity was measured at pH 5.5 in first 5 strains and at pH 4.5 in the last three deletion strains. Protease activity is against green fluorescent casein. The six-fold protease deletion strain has only 6% of the wild type parent strain and the 7-fold protease deletion strain protease activity was about 40% less than the 6-fold protease deletion strain activity.

Example 16

IGF1 Production in the 13-Fold Protease Deletion Strain

An IGF1 expression cassette was created from a plasmid, which contained cbh1 promoter, terminator and 3'flank and amdS marker, to express IGF1 as a fusion protein with CBHI carrier and without any carrier cleavage sites or purification tags. The construct was designed to be integrated into the cbh1 locus under control of the native cbh1 promoter and terminator. The expression construct was cut out of the vector with PmeI and purified via standard methods. The *Trichoderma* transformation was made into the 13-fold protease deletion strain M1076 using AmdS selection marker (M1076 was generated from M901 by deleting pep9 (tre79807)). Transformants were screened by PCR for loss of cbh1 orf and proper integration of the expression cassette into the locus.

The CBHI carrier sequence: SEQ ID NO. 924.

The IGF1 protein sequence expressed: SEQ ID NO. 925.

The M1140 was grown in the fermentator cultivation T189 without the use of protease inhibitors in TrMM with 20 g/L yeast extract, 40 g/L cellulose, 100 g/L cellobiose, 40 g/L sorbose at pH 4.5 in a 1 liter fermentor. The temperature was shifted from 28° C. to 22° C. after 48 hours.

The expression level was checked via immunoblotting. The samples were diluted in orange LSB so that 0.0125 µl of supernatant could be loaded per well in a 4-20% Criterion gel. Immunoblotting was done to dual detect the IGF1 and CBHI expression. Detection was done with rabbit anti-IGF1 diluted to 0.25 µg/ml in TBST (Abcam rabbit polyclonal antibody, ab9572) and anti-CBHI mab261 diluted 1:10,000 in TBST. The secondary antibody was goat anti-rabbit IgG 1:30,000 dilution in TBST (Li-Cor #926-68071, IRDye 680RD goat anti-rabbit IgG). The anti-mouse CBHI antibody was detected with Li-Cor #926-32210 IRDye 800CW goat anti-mouse IgG diluted 1:30,000 in TBST. Washed for 1 hour in TBST and rinsed with TBS. The filters were scanned with LI-COR Odyssey CLx Infrared Imaging System at 700 nm and 800 nm The expression of IGF1 was measured from 44 hours to 162 hours compared to an IGF1 standard curve. The expressed fusion protein was around 70 kD. At 71 hours the expression level was 3.5 g/L. The highest expression level measured was 7.9 g/L at 92 hours. At 116 hours the expression level reduced to 6.6 g/L. The IGF1 expression reduced significantly after 116 hours in this batch cultivation. The $CO_2$ peak was around 92 hours, which correlated well with the expression peak. After 116 hours the IGF1 protein was degraded off the carrier and only CBHI protein could be seen in the samples. CBHI expression could be observed from 71 hours until 162 hours. No protease inhibitors were used in this cultivation. The 13 protease deletions improved the stability of the IGF1. Protease inhibitors may be needed to reach higher production levels in strains having less protease deletions. With M1140 it would be possible to achieve higher production levels if more cellulose was used in the cultivation.

The M231 production strain was made to produce a CBHI-TEV site-IGF1 fusion protein in a strain with no protease deletions, M124. The TEV protease cleavage site was included in between the CBHI carrier and IGF1. IGF1 was very stable and remained predominately in the fusion form after secretion into the supernatant. The expression construct contained the CBHI carrier-TEV cleavage site-IGF1 protein sequence and was designed to be integrated into the CBHI locus under control of the native promoter and terminator. After transformation transformants were screened by PCR for loss of cbh1 orf and proper integration of the expression cassette into the cbh1 locus. The final transformant was named M231.

CBHI carrier sequence used to create M231 was the same as for IGF1 above except after C-terminal amino acids " . . . TTTGSS" of the CBH1 amino acids "PGP" were included before TEV cleavage site (ENLYFQ).

A second strain that produced an IGF1 variant called BVS857 was made in a similar way as M231 but the expression construct included a strepII tag and spacer before the TEV cleavage site. The expression cassette was integrated into the cbh1 locus under control of the native cbh1 promoter and terminator. The vector was digested with PmeI, the expression cassette was gel purified, and was transformed into the M194 strain and selected for using AmdS selection. Transformants were screened by PCR for loss of cbh1 orf and proper integration of the expression cassette into the cbh1 locus. The resulting strain M236 strain produced a CBHI-streptII tag-3×(GGGS)-TEV site-BVS857 fusion protein. The strepII tag was added to allow for purification, which could be conveniently removed afterward with TEV protease treatment.

The IGF1 strain M231 has no protease deletions, while the BVS857 strain M236 has the pep1 and tsp1 protease deletions. Both these strains were expressed as stable CBHI-IGF1 fusions into the supernatant. The M231 and M236 were cultivated in 1 L fermentors in the presence of chymostatin (20 µM) and pepstatin (10 µM) inhibitors. Both strains were cultivated in TrMM with 20 g/L yeast extract, 40 g/L cellulose, 100 g/L cellobiose, 40 g/L sorbose at pH 4.5 with chymostatin and pepstatin inhibitors added on day 3, 4, and 5. The temperature was shifted from 28° C. to 22° C. after 48 hours.

The production levels were assessed by immunoblotting. The M231 culture supernatant was diluted with orange LSB so that 0.025 µl could be loaded into a 10 µl volume into a 4-20% criterion gel with IGF1 standards. The M236 culture supernatant was diluted so that 0.05 µl of supernatant was loaded to each well along with BVS857 standards onto a 4-20% criterion gel. Both blots were detected with rabbit anti-IGF1 diluted to 0.25 µg/ml in TBST (Abcam rabbit polyclonal antibody, ab9572) and anti-CBHI mab261 diluted 1:10,000 in TBST. The secondary antibody was goat anti-rabbit IgG 1:30000 dilution in TBST (Li-Cor #926-68071, IRDye 680RD goat anti-rabbit IgG). The anti-mouse CBHI antibody was detected with Li-Cor #926-32210 IRDye 800CW goat anti-mouse IgG diluted 1:30,000 in TBST. Washed for 1 hour in TBST and rinsed with TBS. The filters were scanned with Li-Cor Odyssey CLx Infrared Imaging System at 700 nm and 800 nm The strain M231 demonstrated that up to 19 g/L of IGF1 could be produced as a fusion to CBHI carrier at 118 hours. The fusion protein ran around 75 kD on the immunoblot. The CBHI-IGF1 fusion protein expression level was 2 g/L at 72 hours, 10 g/L at 95 hours, 16 g/L at 101 hours, and 19 g/L at 118 hours. The CBHI expression level accumulated throughout the batch cultivation from 49 hours to 118 hours.

With strain M236 up to 7 g/L of the BVS857 variant could be produced as a CBHI carrier fusion at 101 hours. The fusion protein ran around 75 kD on the immunoblot. The CBHI-BVS857 fusion protein expression level was 2.7 g/L at 72 hours, 6.2 g/L at 95 hours, 7.0 g/L at 101 hours, 5.1 g/L at 118 hours, and 2.5 g/L at 140 hours. As a fusion with CBHI carrier both these IGF1 proteins are stably expressed into the supernatant.

The M236 IGF1-BVS857 productions strain was further cultivated in fermentors with and without chymostatin and pepstatin inhibitors to see the effect of proteases. This strain was cultivated previously with inhibitors and using 40 g/L cellulose. The M236 strain was cultivated in TrMM with 20 g/L yeast extract, 80 g/L cellulose, 100 g/L cellobiose, 40 g/L sorbose at pH 4.5 with and without chymostatin and pepstatin inhibitors added on day 3, 4, and 5. The temperature was shifted from 28° C. to 22° C. after 48 hours.

No CBHI-BVS857 fusion protein or free protein could be detected in the supernatant samples taken from 71 to 115 hours in strain M236 (no added protease inhibitors). Only the CBHI carrier protein could be detected accumulating in the supernatant during that time. The same strain grown in the presence of chymostatin and pepstain inhibitors produced up to 9 g/L of CBHI-BVS857 fusion at 104 hours. The BVS857-CBHI fusion protein was detected at 75 kD. The expression level determined was 3.0 g/L at 71 hours, 6.3 g/L at 92 hours, 4.9 g/L at 98 hours, 9.0 g/L at 104 hours, and 7.8 g/L at 115 hours. The CBHI carrier levels increased throughout the culture and was maximal at 115 hours. Thus, the improvement in BVS857-CBHI production levels was dramatic and due to protease inhibition.

With the use of 40 g/L of cellulose production levels of 7.0 g/L was reached at 101 hour for BVS857-CBHI and with 80 g/L of cellulose production levels were 9.0 g/L at 104 hours. This demonstrates that higher production levels are achieved by adding more cellulose to the culture medium.

CBHI-streptII tag-3×(GGGS)-TEV site-BVS857 fusion protein from M236 was purified via strep-tag affinity column (IBA GmbH) according the manufacture's protocol. The culture supernatant (600 µl) was applied to the column and washed with 10 volumes of wash buffer. The column was eluted with elution buffer containing 2.5 mM desthiobiotin. The fractions were run on a 4-20% criterion gel and stained with gel code blue Coomassie strain. The eluted fractions #2 and #3 contained concentrated protein that was slightly less than 75 kD, where the BVS857 fusion protein should run.

The eluted fraction #2 was used for testing TEV protein cleavage efficiency. The AcTEV protease (Invitrogen, catalog#12575-015) was used for overnight incubation at 8° C. with different amounts of enzyme. Standard amounts of IGF1 were used on the immunoblot to quantify the amounts IGF1 present in each reaction. The amount of TEV was varied to evaluate its effectiveness (0, 1 µl, 5 µl, 10 µl, or 15 µl). TEV (5 µl) plus BVS857 control (4 µg) showed that there did not seem to be any significant TEV protease activity against BVS857. The baseline amount of IGF1 in the carrier fusion sample was 687 ng. Using 1 µl (10 units) TEV enzyme converted 46% of the fusion after 16 hours at 8° C. The 5 µl (50 units) amount converted about 95% of the fusion. This peaked at 97% when 10 µl (100 units) of TEV was used. The TEV enzyme gave a background staining in the immunoblots at 25 kDa. The released BVS857 product at the size of the native IGF1 could be easily observed around 10 kDa, but was below the standard curve range. PMSF was used in the reaction buffer, but it did not seem to neutralize the protease activity responsible for degrading the BVS857 after it was released from the carrier. The strain producing this material had only 2 protease deletions so protease inhibitors were used to try to control the protease activity. This experiment showed that the internal strepII tag can be used to affinity purify the CBHI fusion protein from supernatant and the TEV cleavage site is efficiently cut in order to release the model protein such as IGF1.

Example 17

FGF21 Expression Strains in the 13-Fold Protease Deletion Strains

The first FGF21 production strain was made in M369 (Δpep1Δtsp1Δslp1Δgap1Δgap2, see Example 4 of WO2013/102674) using vector with an FGF21 expression cassette targeted to the cbh1 locus, which contained a hygromycin marker. The vector was digested with PmeI and processed for transformation into the M369 strain, and transformants were selected for with hygromycin. The expression construct produced a CBHI carrier-NVISKR kex2 site-FGF21 fusion protein, so that the secreted protein would be the free FGF21 protein. Correct integration into the locus and absence of the cbh1 orf was checked by PCR.

The CBHI carrier sequence was the same as for IGF1 above, followed by NVISKR Kex2 cleavage site and FGF21 sequence: SEQ ID NO. 926.

The M393 strain was grown with and without protease inhibitors pepstatin A, chymostatin, or soybean trypsin inhibitor. Independent wells were chosen for control wells where no inhibitors were added. This strain was grown in 3 ml of TrMM with diammonium citrate without ammonium sulfate, 100 mM PIPPS, 20 g/L spent grain extract, 40 g/L lactose adjusted to pH 4.5. The 24 well plates were shaken at 800 rpm at 85% humidity. The plate was covered with an air permeable membrane and the cultures were grown for 6 days.

Inhibitors were added first on day 3 and then added daily until day 6. 200 µl samples were taken from the culture wells beginning on day 3. The mycelium was spun down for 5 minutes at 13 k and the supernatant collected. From the culture supernatant 5 µl plus LSB was loaded in a 4-20% SDS PAGE gel and immunoblotting made on nitrocellulose with rabbit anti-FGF21 (2 µg/ml) and goat anti-rabbit IgG AP conjugated secondary antibody diluted 1:10,000. FGF21 standard were included on the blot for quantification.

Figure 12:
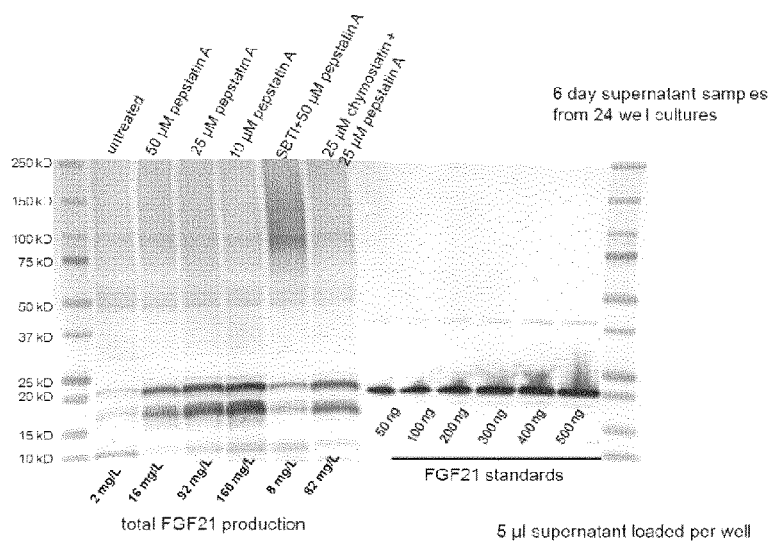
FIG. 12 FGF21 production in 24 well cultures treated with protease inhibitors. Supernatant samples from day 6 were assayed via immunoblotting with a FGF21 standard curve. The primary antibody and reference material was provided by Novartis. The primary antibody was diluted to 2 μg/ml in TBST before use. The goat anti-rabbit secondary (Biorad goat anti-rabbit AP #170-6518) was diluted 1:10,000 in TBST.

FGF21 was very sensitive to protease degradation. On day 6 without treatment only about 2 mg/L of total protein could be produced of which very little was full length material (FIG. 12). With 10 µM pepstatin A added to the cultures the production could be improved up to 160 mg/L on day 6. In the presence of inhibitor a major degradation product around 18 kD was detected. Adding SBTI or chymostatin, in addition to pepstatin A, did not produce an additional benefit. SBTI addition resulted in a much more acidic culture sample and thus produced a negative effect on the production level. Combination of pepstatin A and SBTI provided the most benefit as it allowed for 204 mg/L of total FGF21 to be produced. The expression levels were in the 1-12 mg/L range in the presence of single inhibitors and untreated cultures reached about 1 mg/L. It was important to inhibit both the aspartic proteases and the serine proteases to effectively produce FGF21.

The M393 strain was cultured in the fermentor in TrMM plus 2% yeast extract, 4% cellulose, 8% cellobiose, 4% sorbose, pH 4.5 with temperature shifted from 28° to 22° at 48h. When FGF21 expression was analysed via immunoblotting the highest expression level was seen on day 3 where there was a 10 kD degradation product produced at 130 mg/L. No full length FGF21 was observed. The FGF21 was very protease sensitive when produced in the 5-fold protease deletion strain. More protease activity reduction would be required via inhibitor treatment or protease deletions. When inhibitors were used in 24 well cultures lots of protein was observed, suggesting FGF21 seemed to be well secreted but was just sensitive to degradation.

An FGF21 expression vector with AmdS marker was transformed into the strain M1076 and M1085 (slp7 deletion with pyr4-hygromycin double marker).

The pTTv470 vector was created by taking the AmdS marker as a NotI fragment from pTTv249 and adding it to the previously made pTTv174 FGF21 expression vector. The selection marker was simply exchanged to create the new vector. The expression cassettes in pTTv174 and pTTv470 were identical. The pTTv470 vector was digested with PmeI, the expression cassette was gel purified, and the FGF21 expression cassette with AmdS marker was transformed into the two of the 13-fold protease deletion strains M1076 (pep9 deletion) and M1085 (M901 with slp7 deletion). Following the AmdS selection, the resulting transformants were screened by PCR for correct 5' and 3' integration and presence or absence of cbh1 open reading frame. The primer pairs used are shown below in table 17.1.

TABLE 17.1

Primers for screening integration into the cbh1 orf.

5' integration, T095 + T096, ~2.8 kb (2776 bp), 58° C.

| | |
|---|---|
| T095_Ann112_F_cbhI_Ben | GCTGTTCCTACAGCTCTTTC (SEQ ID NO: 927) |
| T096_Ann113_R_cbhI_Exon_Ben | AGCCGCACGGCAGC (SEQ ID NO: 928) |

3' integration, T008 + T022, ~1.9 kb, 60° C.

| | |
|---|---|
| T008_pHH01-CBHIloc_cbh13'flankOutRev | GGTTGACTTACTCCAGATCG (SEQ ID NO: 929) |
| T022_Amds_start_rc_seg | CTGAAGCAACAGGTGCCAAG (SEQ ID NO: 930) |

ORF, T1720 + T1721, gives a PCR band of 770 by if the cbh1 gene is not deleted. Pure transformants do not give signal. 68° C.

| | |
|---|---|
| T1720_cbh1intronfor | CCTGACGCTATCTTCTTGTTGG (SEQ ID NO: 931) |
| T1721_cbh1intronrev | CGCGCATGTTTGTCCATCAAAC (SEQ ID NO: 932) |

Positive transformants were found for both transformed strains. The M1076 transformation produced 13 good transformants and the M1085 produced 2 good transformants. These transformants were cultivated in 24 well cultures and compared to the earlier FGF21 production strain M393. The transformants and the control were grown in 10 g/L yeast extract, 20 g/L cellobiose, 10 g/L sorbose with PIPPS, pH 4.5. The cultures were started by adding $1 \times 10^7$ spores into 50 ml of culture medium and adding 3 ml of culture medium plus spores to each well ($6 \times 10^5$ spores/well). 100 µl of each culture supernatant was collected on days 4, 5, and 6. The mycelium was spun down and orange LSB was added to the supernatant and the samples were heated for 5 minutes. 5 µl and 2 µl of the supernatant+LSB was loaded per well into 4-20% Criterion TGX gel. The gels were run and the proteins were transferred to nitrocellulose membrane.

The expressed FGF21 was detected by immunoblotting. The rabbit anti-FGF21 antibody was diluted to 2 µg/ml in TBST. The stock concentration provided was 3600 µg/ml (from Novartis). The goat anti-rabbit secondary IRDye 680 was diluted 1:30,000 in TBST. The primary and secondary antibody incubations were done for 1 hour at room temperature with shaking To detect the carrier CBHI levels the anti-CBHI antibody mab261 was diluted 1:10,000 in TBST. The goat anti-mouse IRDye 800 secondary antibody was diluted 1:30,000 in TBST. Washed the membranes with TBST for 1 hour and rinsed with TBS. The blots were scanned at 700 and 800 nm.

Figure 13:
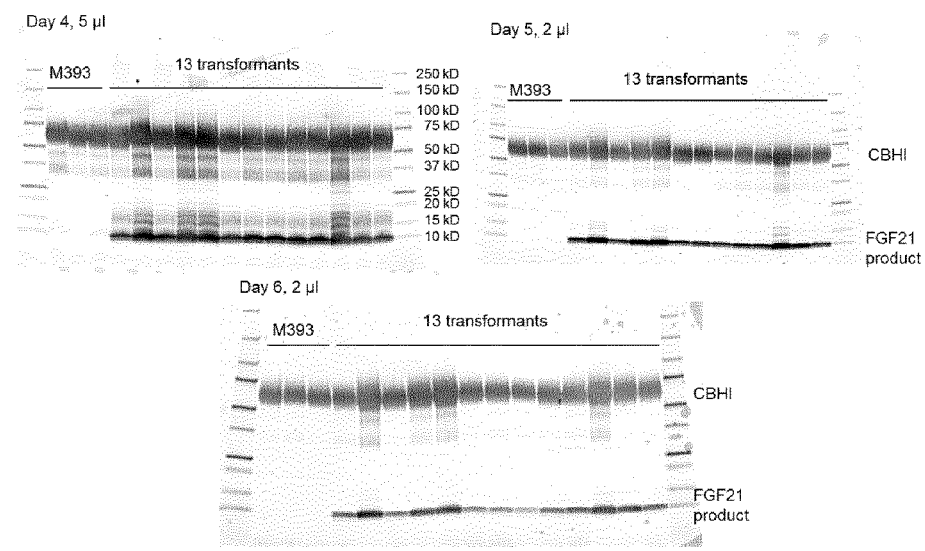
FIG. 13 Immunoblot detecting FGF21 and CBHI expression from the M393 control strain and the new FGF21 transformants from day 4-6. The new transformants are from M1076 transformation. CBHI carrier was detected around 60 kD and the FGF21 free product was at 10 kD.

The day 4, day 5, and day 6 samples were analysed for FGF21 and CBHI expression. The difference between the M393 control strain and the new transformants with 13 protease deletions was dramatic. The secreted FGF21 was primarily observed as a 10 kD product. This product was only faintly visible in the M393 supernatants from day 4, but was massively expressed in supernatant from all of the 13 new transformants (FIG. 13). On later days there was no FGF21 detected from the M393 strain. There was free CBHI carrier expressed in all the M393 control samples as well as in the new FGF21 transformants. This indicated that all the strains secreted both the CBHI carrier as well as the FGF21 protein, but there was too much protease activity for the FGF21 in the M393 strain. The eight additional proteases deleted in the new transformants dramatically improved the stability of the FGF21. Four of the transformants #24, 36, 48, and 73 seemed to produce higher amounts of CBHI and FGF21 compared to the nine other transformatants. The difference was particularly obvious on days 5 and 6. After Southern analysis this was determined to be due to multiple integration of the FGF21 expression cassette. The lower expression levels correspond to single copy integration. The M393 strain has 5 protease deletions, while the new strains produced have 13 proteases deleted. The transformants from the transformation of the M1085 strain were done in parallel. The results were similar as those seen in FIG. 16. The M1085 based strain also produced FGF21 product mainly at 10 kD, but there was a weaker 17 kD product visible on day 4.

Southern blot analysis was done on the several transformants. Transformant numbers #20, 24, 36, 48, 55, 73 from the M1076 strain and #4 and 39 from the M1085 were analysed via Southern blot using radioactive detection. The genomic DNA was digested with PstI for integration checking. Two PCR fragments were used as the probes for the cbh1 promoter and for the cbh1 3' flank. The primers used to create the fragments are listed below.

cbh1 promoter probe, 799 bp fragment, 35 ng/µl (tube labelled 5-probe)

| | |
|---|---|
| T173_pcbhl_seq_r1 | CAAAGGCCGAAGGCCCGAGG (SEQ ID NO :933) |
| T1679 | CAACCTTTGGCGTTTCCCTG (SEQ ID NO :934) | cbh1 3' flank probe, 796 bp fragment, 32.2 ng/µl (tube labelled 3' probe)

| | |
|---|---|
| T178_cbh13flank_seq_f2 | GGCCGCAGGCCCATAACCAG (SEQ ID NO: 935) |
| T1680 | TGAGTGGGGGATGACAGACA (SEQ ID NO: 936) |

The PstI digest and detection with both probes should give two bands at 3.9 kb and 4 kb if correctly integrated into the cbh1 locus. Effectively there will only be one band at 4 kb. The native cbh1 locus gives a signal around 6.7 kb. The transformant numbers 20, 55, 4, and 39 showed the expected integration band at 4 kb. These look to be clean single integrations into the cbh1 locus. As seen from the 24 well culture studies, these transformants displayed a lower expression level than many of the other transformants. The highest expression levels were seen from transformants #24, 36, 48, and 73, which coincidentally showed extra integration signals in the Southern blotting. There was a nonspecific band in all the transformants at 2.3 kb.

The multiple copy containing transformants #24 and #48 were named M1200 and M1201. The single copy strains from transformant #20 and #55 were named M1202 and M1203. From the M1085 based strain transformants #4 and #39 were named M1204 and M1205, which were single copy strains.

The FGF21 production strains were cultivated in the 1 L fermentors with and without protease inhibitors. Cultivations were done with M1200, M1201, M1204, and M1205 strains. These strains were cultivated in TrMM with 20 g/L yeast extract, 40 g/L cellulose, 100 g/L cellobiose, 40 g/L sorbose at pH 4.5. Pepstatin, chymostatin, and SBTI inhibitors were added to the M1200 and M1205 cultures on day 3, 4, and 5. The supernatant samples were diluted in orange sample buffer so that 0.1 µl of supernatant could be loaded per well into a 4-20% Criterion PAGE gel.

The expressed FGF21 was detected by immunoblotting as above.

Figure 14:
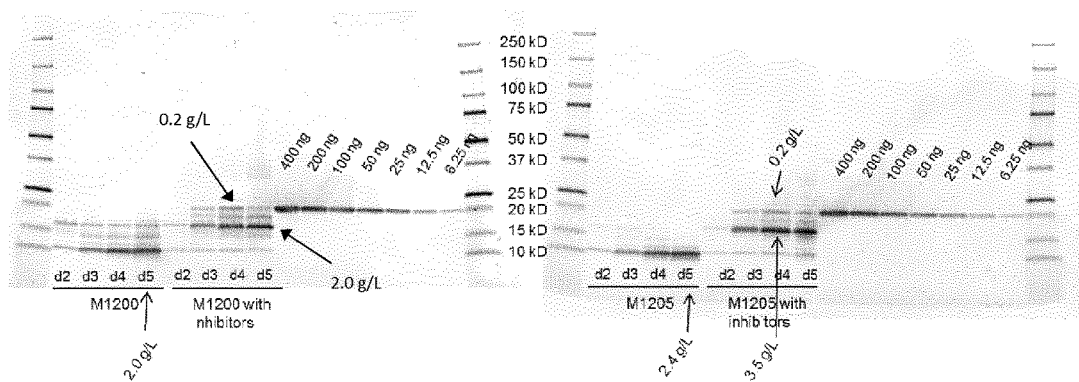
FIG. 14 Immunoblot using anti-FGF21 antibody to detect expression of FGF21 from fermentation samples from cultivation of strain M1200 and M1205 with and without inhibitors. Standard amounts of FGF21 are included on each blot for quantitation. Supernatants were diluted so that 0.1 μl was loaded per lane.

The cultivation of M1200 primarily produced a 10 kD product, but there were higher molecular weight products up to 17 kD (FIG. 14). The full length FGF21 ran at 20 kD. On day 5 there was 2.0 g/L of the 10 kD product. Use of inhibitors increased the stability of the secreted FGF21. The major product was now 17 kD and produced up to 2.0 g/L on day 5. With inhibitor treatment the full length version of FGF21 could be produced at 0.2 g/L. This appeared to be full length. Cultivation of M1205 produced a 10 kD band at 2.4 g/L on day 5 Inhibitor treatment increased the stability of the FGF21 product to generate a predominate 17 kD form at 3.5 g/L and a full length product at 0.2 g/L on day 4 (FIG. 14). Samples from the cultivation of M1201 had a technical problem with the fermentor system (analysis not shown). The M1204 strain was analysed and gave similar expression levels, 2.5 g/L, of the 10 kD product on day 5. The 10 kD product was lowest on day 2 and was highest on day 5.

The inhibitor treatment demonstrated that it would be possible to fully stabilize the FGF21 protein. Further protease deletions to produce FGF21 (without added protease inhibitors) include but are not limited to slp2, pep8, and pep11.

Inhibitor Studies on FGF21 Production Strain

To investigate which classes of proteases are contributing most to the degradation of the FGF21 protein individual protease inhibitors we tested in 24 well cultures.

Chymostatin and SBTI are known to inhibit SLP2 and SLP7 subtilisin proteases that are still expressed in the M1200 strain. Pepstatin inhibits aspartic proteases such as PEP8, PEP11, PEP12 which are known to be secreted into the supernatant. 1,10-phenathroline targets mainly zinc metalloproteases which are secreted by *Trichoderma*. The M1200 strain was cultivated in 24 well format in TrMM with 10 g/L yeast extract, 20 g/L cellobiose, 10 g/L sorbose, PIPPS buffered at pH 4.5. Chymostatin, phenathroline, and pepstatin were used at a final concentration of 10 µM and SBTI was used at 0.1 mg/ml. Each treatment was done in duplicate wells and the untreated control was cultured in 4 wells.

The cultures were started by adding $1 \times 10^7$ spores into 50 ml of culture medium and adding 3 ml of culture medium plus spores to each well ($6 \times 10^5$ spores/well). 100 µl of each culture supernatant was collected on days 4, 5, and 6. The mycelium was spun down to remove only the supernatant. Orange LSB was added and the samples were heated for 5 minutes. 2 µl of the supernatant+LSB was loaded per well into 4-20% Criterion TGX gel. The gel was run and proteins were transferred to nitrocellulose membranes.

The expressed FGF21 was detected by immunoblotting as above. A commercially purchased N-terminal antibody rabbit polyclonal from Abcam (#ab66564) and C-terminal rabbit polyclonal antibody from Abcam (#ab137715) were used in some cases.

Figure 15:
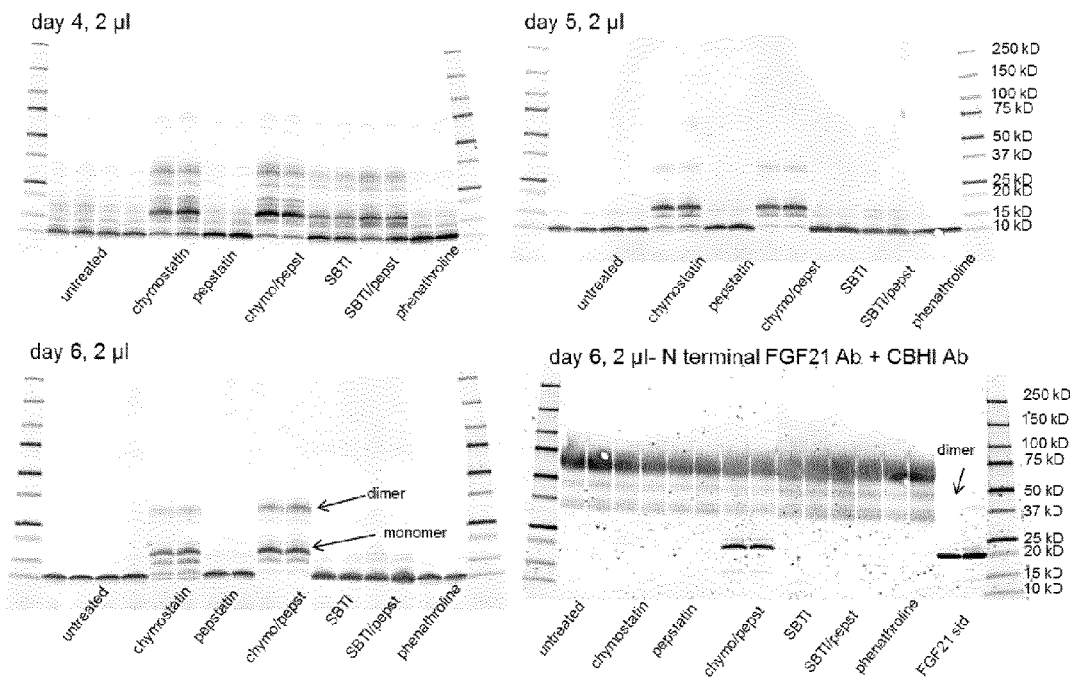
FIG. 15 Immunoblot detecting FGF21 expression from the M1200 strain grown in 24 well culture with and without protease inhibitor treatment. Pepstatin, chymostatin, 1,10-phenanthroline were used at a final concentration of 10 μM and SBTI was used at 0.1 mg/ml. 2 μl of the culture supernatant plus orange LSB was loaded per well. Whole anti-FGF21 antibody was generally used to detect all forms of FGF21 produced, but in the lower right blot an N-terminal antibody was used to detect the N-terminal containing forms. Also in the lower right blot anti-CBHI antibody was used for detection.

Without inhibitor treatment the M1200 strain produced mainly a 10 kD product, but there were some larger forms visible in the day 4 samples (FIG. 15). Chymostatin treatment improved the stability of the protein allowing a 17 kD major product. There were small amounts of the full length form visible and a dimer form around 37 kD after chymostatin treatment. Pepstatin, SBTI, and 1,10-phenathroline treatment only improved the expression level of the 10 kD form. However, when chymostatin and pepstatin were combined there was a synergetic effect on the stabilization. The combined treatment promoted almost complete stabilization of the full length form and reduced the lower molecular weight products. This was most apparent in the 6 day culture samples, where mainly the full length FGF21 could be visualized. The appearance of the dimer was strongest with this treatment. Proper formation of the dimer indicates that the molecule has a C terminal cysteine residue needed for dimerization.

Figure 16:
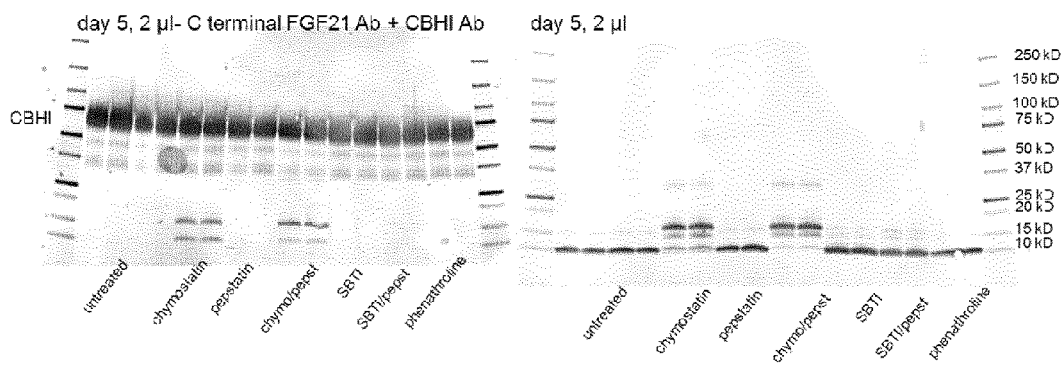
FIG. 16 Immunoblot detecting FGF21 expression from the M1200 strain grown in 24 well culture with and without protease inhibitor treatment. Pepstatin, chymostatin, 1,10-phenanthroline were used at a final concentration of 10 μM and SBTI was used at 0.1 mg/ml. 2 μl of the culture supernatant plus orange LSB was loaded per well. Whole anti-FGF21 antibody and a C-terminal antibody were used to detect specifically the C-terminus and all forms of the FGF21 protein. In the left blot anti-CBHI antibody was used for detection.

The culture samples were probed also with an N- and C-terminal antibody. The dual treatment with chymostatin and pepstatin generated a full length product that reacted to the N-terminal antibody as well as the FGF21 standard (FIG. 15). When the C-terminal antibody was used to detect FGF21 produced in the 5 day samples two products were observed when treated with chymostatin or chymostatin/pepstatin (FIG. 16). These appear to be the full length protein and the lowest 10 kD form. Chymostatin treatment was enough to stabilize the C-terminus of the protein. To maintain the N-terminus both chymostatin and pepstatin were necessary.

The data from the day 4 immunoblots was quantified to make comparisons of which inhibitors were most effective. The 1,10-phenathroline treatment best improved the total amount of FGF21 produced, thus indicating that zinc metalloproteases were likely involved (Table 17.2). There are many candidates such as mp1, mp2, mp3, mp4, and mp5. The full length form seems to be degraded by a subtilisin and an aspartic protease. The SLP2 protease is most likely to be the primary problem for the stability and can be addressed by, for example, deleting the gene, silencing the gene, or switching the promoter of the gene. Deleting or silencing aspartic proteases PEP8, PEP11, and PEP12 found in the supernatant may further increase the stability of FGF21. In some embodiment, full-length production of FGF212 may only need deletion of two proteases, slp2 and pep8, in the strain M1200.

TABLE 17.2

Fluorescent units of FGF21 expression measured from the day 4 immunoblot shown in FIG. 15.

|  | lower band | upper band | total product |
|---|---|---|---|
| untreated | 27350 | 1521 | 28871 |
| chymostatin | 19500 | 34200 | 53700 |
| pepstatin | 51050 | 1610 | 52660 |
| chymostatin/pepstatin | 13100 | 49300 | 62400 |
| SBTI | 37050 | 13800 | 50850 |
| SBTI/pepstatin | 35850 | 20400 | 56250 |
| 1,10-phenathroline | 68800 | 774 | 69574 |

Example 18

Reducing slp2 Expression by Replacing its Promoter slp2 affects in some level growth and sporulation and therefore slp2 promoter was replaced with a promoter which is expressed in lower levels (of all identified proteases slp2 mRNA was expressed the highest levels in the conditions described in the last Example).

The promoters from the sporulation induced flavin containing monooxygenase gene tre76230, the RNA polymerase gene tre49048, and the slp8 protease gene tre58698 were chosen for replacement into the slp2 promoter locus. All genes appeared to be moderately expressed at levels less than those seen with slp2.

A promoter region from the 3 genes was amplified by PCR and inserted into a vector with slp2 flank sequences that would direct the promoter into the correct position as the new slp2 promoter. The promoter cassette contains the hygromycin marker upstream of the new promoter. The vectors were digested with PmeI, the replacement promoter constructs were gel purified, and transformed in the M507 MAB01 production strain under hygromycin selection conditions. Two transformants from each Transformants were isolated and named M773/M774, M775/M776, and M777/M778, respectively.

Promoter sequence for tre76230 promoter replacement: SEQ ID NO: 937.
Promoter sequence for tre49048 promoter replacement: SEQ ID NO: 938.
Promoter sequence for tre58698 promoter replacement: SEQ ID NO: 939.

These transformants and the M507 control strain were cultivated in 24 well plates using TrMM with 1% yeast extract, 2% cellobiose, 1% sorbose, pH 5.5. Samples were taken on days 5, 6, and 7. Immunoblotting was done with AP conjugate antibodies to detect the heavy and light chain. The culture supernatants were diluted so that 0.5 µl was loaded per lane. Detection was visualized with AP substrate.

Figure 17:
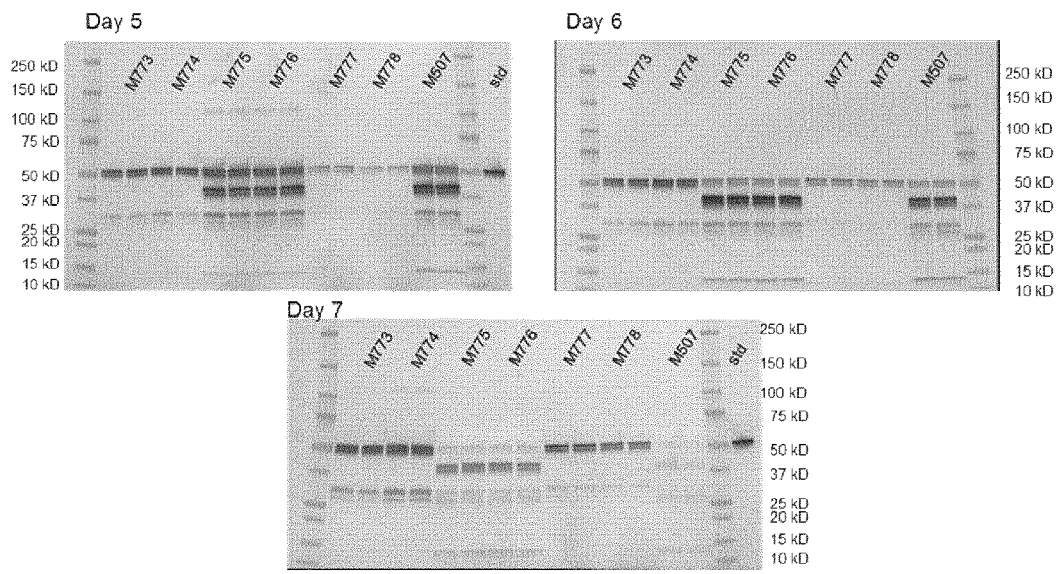
FIG. 17. Immunoblots showing the MAB01 heavy chain expressed in 24 well cultures. 0.5 µl of each supernatant was loaded into a 4-15% gel. Detected with anti-IgG heavy chain AP conjugate (Sigma# A3188) diluted 1:10,000 in TBST. Developed with Promega AP substrate.

The heavy chain was clearly more stable in the M773/M774 and M777/M778 transformants (FIG. 17). The most striking point is on day 7. The M507 heavy chain is almost fully degraded, while the M773/M774 heavy chain survived very well. The other remarkable feature was that there was no upper degradation product at 37 kD. There are only some lower degradation products around 28 kD. The M773/M774 strains grew well, but the M777/M778 strains were not growing that well and had trouble sporulating. Thus, the preferred strain would be M773 or M774. Total protease activity measurements with casein correlated and indicated that M773/M774 and M777/M778 have low protease activity.

When the light chains were detected via immunblotting there was less light chain in M773 and M774 compared to control. There was particularly less light chain with M777 and M778 strains. The M775 and M776 light chain amounts were similar to control. There seemed to be good agreement between the light chain amounts seen on the blots and the total immunoglobulin detected. The total IgG was measured from these cultures and showed that all of the promoter exchange strains had lower antibody expression, except for M775 and M776, which were very similar to control (Table 18.1). The M773/M774 strains had levels less than half M507. Thus, there might be something affecting the growth of some of the promoter replacement strains, in this small culture format.

TABLE 18.1

Total antibody concentrations from 24 well culture day 7.

| Strain | Total mAB (protein G bound) µg/ml |
|---|---|
| M773 | 166 |
| M774 | 225 |
| M775 | 489 |
| M776 | 487 |
| M777 | 68 |
| M778 | 50 |
| M507 control | 503 |

The M774 and M775 strains were fermented. The two strains were cultivated in TrMM plus 20 g/l yeast extract, 40 g/l cellulose, 80 g/l cellobiose, and 40 g/l sorbose at pH 5.5 with the temperature shifting from 28° to 22° at 48 hours for 10 days. The control strain M667 was cultivated under the same conditions and under similar conditions where 120 g/l cellulose was used. Samples were taken for immunoblotting and total immunoglobulin determination. The supernatants were diluted so that 0.05 µl was loaded per well in a 4-15% gel Immunoblotting to detect the light chain was done with an AP conjugated antibody (A3818) diluted 1:10,000 in TBST. The heavy chain was detected with an anti-human Fc antibody IRDye 700 DX conjugate (Rockland #609-130-003) diluted 1:30,000 in TBST. The fluorescence at 700 nm was detected using an Odyssey CLx near infrared imager (Li-Cor).

Figure 18:
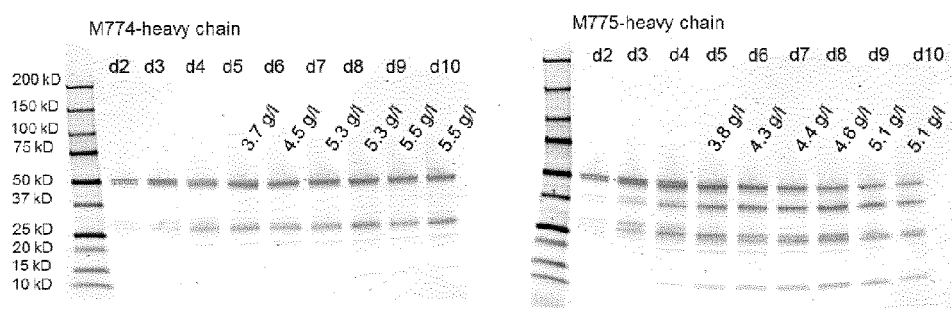
FIG. 18 Immunoblots showing the MAB01 heavy chain. 0.05 µl of each supernatant was loaded into a 4-15% gel. The heavy chain was detected with an anti-human Fc antibody IRDye 700 DX conjugate (Rockland #609-130-003) diluted 1:30,000 in TBST. The fluorescence at 700 nm was detected using an Odyssey CLx near infrared imager (Li-Cor).

The MAB01 heavy chain produced from M774 looked remarkably good (FIG. 18). The results were similar to those seen in the 24 well cultures. There was only one major degradation product around 25 kD. Typically, the heavy chain looks like that produced by M775. Normally there are degradation bands at 38 kD, 28 kD, and 10 kD. The disappearance of the 10 and 38 kD products may be explained by reduction of SLP2 activity because there are subtilisin cleavage site closer to the N terminus of the MAB01 heavy chain and without high slp2 expression the heavy chain is no longer cleaved at that position. The 28 kD product comes when proteases cleave the heavy chain in the hinge region. The cleavage sites in the hinge are more typical of sedolisin or trypsin like proteases. They don't appear to be caused by SLP2. The 10 kD product results when the hinge and the near N terminal sites are both cleaved.

No obvious differences were seen between the M774 and M775 light chain amounts or carrier bound percentages. While M775 is not optimal control strain, it resembles M507 very much, as seen in the 24 well culture data described above. This data also suggests that SLP2 does not appear to be cleaving the carrier-light chain fusion. Otherwise the amount of carrier bound material would increase dramatically when the slp2 expression level was reduced.

M774 strain slightly outperformed M775 when the total antibody amounts are compared (Table 18.2). The total antibody amounts are also listed on the heavy chain immunoblots. The biggest difference can be seen on day 7 and 8, where M774 produced 5.3 g/L on both days. The M775 produced 4.4 and 4.6 g/L on those days. The most important difference was observed once the amounts of full length antibody are measured and compared. The M774 produced a far more intact heavy chain. On day 7, the M774 strain produced 71% full length, while the M775 was 37% full length. The M774 strain could maintain 65% full length antibody up to 10 days, whereas the M775 strain produced only 14% full length material. In terms of quality, the control strain M667 (with a slp2 gene silencing construct) was similar to M774 (Table 18.2). However, the M667 production strain produced slightly higher amounts of total antibody, at levels reaching 6.1 g/L on day 10 under the same culture conditions. With increased cellulose (120 g/L) the M667 strain could produce as high as 7.1 g/L of total antibody on day 10 (Table 18.2).

From these data, another approach to reduce SLP2 activity was generated. Replacing SLP2 promoter led to less expression of the SLP2 protease and resulted in remarkably low heavy chain degradation. Some effects on growth and sporulation were still observed, but they were far milder than those seen with the complete deletion of the SLP2 gene. By giving slp2 a sporulation induced promoter it may have addressed this sporulation related problem. Any growth defect seen in M774 can be compensated with modifications in fermentation processes.

TABLE 18.2

Total antibody and full length antibody quantitation from fermentor cultivation supernatants of strains M774, M775, and M667 cultivations.

| Fermentation | Sample (day) | Total mAB (protein G bound) µg/ml | Full-size mAB (gel filtration) µg/ml | % |
| --- | --- | --- | --- | --- |
| M774 | 5 | 3704 | — | — |
|  | 6 | 4542 | — | — |
|  | 7 | 5301 | 3776 | 71 |
|  | 8 | 5290 | 3583 | 68 |
|  | 9 | 5453 | 3548 | 65 |
|  | 10 | 5455 | 3550 | 65 |
| M775 | 5 | 3832 | — | — |
|  | 6 | 4263 | — | — |
|  | 7 | 4436 | 1631 | 37 |
|  | 8 | 4641 | 1222 | 26 |
|  | 9 | 5152 | 974 | 19 |
|  | 10 | 5060 | 690 | 14 |
| M667 | 6 | 4895 | — | — |
|  | 8 | 6005 | — | — |
|  | 10 | 6070 | — | — |
|  | 11 | 6248 | — | — |
|  | 12 | 6676 | — | — |
|  | 13 | 6435 | — | — |
|  | 14 | 6175 | — | — |
| M667 | 6 | 5828 | — | — |
|  | 7 | 6181 | 4024 | 65 |
|  | 8 | 6674 | 4331 | 65 |
|  | 9 | 6885 | 4265 | 62 |
|  | 10 | 7063 | 4171 | 59 |
|  | 11 | 6690 | — | — |
|  | 12 | 4674 | — | — |

The M507 parental strain was compared to the M646 slp2 deletion strain and the M774 slp2 promoter switch strain in a separate fermentor cultivation series. They were grown in TrMM plus 20 g/l yeast extract and 120 g/l cellulose with 50% glucose/12.5% sorbose feed at pH 5.5 with the temperature shifting from 28° to 22° at 48 hours Immunoblotting with anti-heavy and anti-light chain antibodies was done from the day 5 and day 6 samples to visualize the quality and relative amount of heavy and light chain produced.

The M507 started growing a faster than the M646 and M774 strains, but they caught up to M507 later in the culture. There was no significant difference in the amount of free light chain produced by these three strains, as seen on the immunoblot. There was a slightly higher amount of light chain bound to the CBHI carrier in the M646 strain. A small amount of carrier bound heavy chain was detected from the M646 samples and even less was seen in the M774 strain. This could not be detected in the M507 strain. This observations suggests that SLP2 may be involved in processing the CBHI carrier-antibody fusion proteins to some extent in the supernatant or potentially intracellularly.

The M774 strain showed a similar heavy chain degradation pattern to the slp2 deletion strain M646. Both strains were lacking the 10 and 38 kD degradation products that were seen in the M507 parental strain. In the immunoblot the M646 and M774 heavy chains showed only the full sized product at 50 kD and one major degradation product at 25 kD. The amount of full length heavy chain in the M646 and M774 strains was higher compared to M507. The control M507 heavy chain showed two additional degradation products at 10 and 38 kD. This shows that indeed SLP2 protease was responsible for producing these products. The amount of total MAB01 antibody produced on the day 6 time point was similar between the M774 strain and M507 strain, reaching 2.8 g/L under these culture conditions (Table 18.3). Even though the M774 and M507 strains produced the same amount of total immunoglobulin, the quality of the M774 material was much better considering the lack of heavy chain degradation products.

TABLE 18.3

Fermentation data from cultivation of M507, M646, M774. The total antibody titers are shown in the table as g/L.

| Day | M507 (g/L) | M646 (g/L) | M774 (g/L) |
| --- | --- | --- | --- |
| 3 | 1.6 | 1 | 0.8 |
| 4 | 2.3 | 1.4 | 1.5 |
| 5 | 2.7 | 1.8 | 2.2 |
| 6 | 2.8 | 2 | 2.8 |

Example 19

14-Fold Protease Deletion Strain—slp2 (tre123244) Promoter Switch to tre76230 Promoter To generate a 14-fold protease deletion strain with reduced SLP2 activity, the 13-fold protease deletion strain M1077 (pyr4− of M1076) was transformed with MssI fragment of a plasmid targeted to the slp2 (tre123244) locus to replace slp2 promoter with sporulation induced gene tre76230 promoter.

Transformation was carried out using standard protoplast transformation method for pyr4 selection. Transformation was scaled to 2× (i.e. using 500 µl protoplasts). Total amount of DNA used was ~14.6 µg. Colonies growing on transformation plates were picked on selective plates and screened for correct integration of the deletion cassette using primers shown in Table 19.1. Selected clones giving integration signals were purified via single spore purification and rescreened. Clones from three transformants seemed to be pure after one purification round with strong integration signals. Two pure sibling clones from each transformant were plated onto PD+1 M sorbitol for spore suspensions.

The Southern analyses confirmed that all clones were pure slp2 promoter change clones. In addition, majority of the clones give only the expected signal with 5' and 3' flank probes verifying single integration of the deletion cassette to the genome. One clone (78-28B) may have an extra copy of the cassette integrated to the genome. Clone 78-6A has been stored for collection and designated with the code M1162. Clones with slp2 promoter change appear to have somewhat delayed and lower ability to sporulate.

TABLE 19.1

Primers used in screening correct integration of the deletion cassette to the genome and change of slp2 promoter (tre123244) with tre76230 promoter.

| Primer | Sequence |
| --- | --- |
| T1729_slp2_int_check_F | GACACTCCCTTGACTGTAGG (SEQ ID NO: 940) |
| T488_pyr4_5utr_rev | GGAGTTGCTTTAATGTCGGG (SEQ ID NO: 428) |
| T1584_76230_f2 | CATCCCCCAAAGATGATGC (SEQ ID NO: 941) |
| T1585_slp2_3int_orf_r | TGTCATCGAGAGCAGAAGCA (SEQ ID NO: 942) |
| T1393-slp2-5utr-F | CACAACGTACTCGAAGTACC (SEQ ID NO: 943) |
| T1586_slp2_promch_r | AGGTCACTCAGCCTTGTACC (SEQ ID NO: 944) |

Southern Analyses of slp2 Promoter Replacement Strains

Three biological clones with two replicates of the slp2 promoter replacement transformation along with their parental strain M1076 were cultivated for DNA extraction in 24-well plate. After three days mycelia were harvested by vacuum filtration, frozen and lyophilised. Genomic DNA was extracted from mycelia using Easy-DNA kit (Invitrogen) and samples were analysed by PCR using the primers in Table 19.1. None of the clones gave strong signal for slp2 promoter, but a very low amount of product corresponding to expected size was seen for a few clones.

Genomic DNA from M124, M1076 and six Δslp2 promoter replacement strains were digested with HindIII for all analyses (Δslp2 promoter, 5' and 3'flank). Strain M124 was omitted from flank analyses. A control plasmid was digested with MssI for both flank analyses. Primers used to generate probes for hybridisations are shown in Table 19.2.

Fermentor Cultivation of M1162

The M1162 strain was cultivated and compared to the strain M1076. The preculture was grown for 3 days, instead of the normal 2 days. The M1162 was fermented in TrMM with 20 g/L yeast extract, 40 g/L cellulose, 80 g/L cellobiose, 40 g/L sorbose at pH 4.5. The M1162 strain grew a bit slower than its predecessor M1076. The $CO_2$ peak for M1076 came at 75 hours while the M1162 was at 94 hours.

Protease Activity Measurements

The protease activity from the fermentor cultivation samples was analysed. The total protein concentrations from the cultivation samples were measured so that the samples could be adjusted to 1 mg/ml total protein. 100 µl of all the diluted supernatants was added into 96 well plate. Three replicate wells were used per sample. 100 µl of casein FL

TABLE 19.2

Primers used to produce probes for Southern analyses of slp2 (tre123244) promoter change with tre76230 clones.

| Primer | Sequence | Size | Target |
| --- | --- | --- | --- |
| T1393-slp2-5utr-F | CACAACGTACTCGAAGTACC (SEQ ID NO: 945) | 541 bp | slp2 promoter |
| T1586_slp2_promch_r | AGGTCACTCAGCCTTGTACC (SEQ ID NO: 946) | | |
| T1764_slp2_5fprobe_for | TCAGATGGAGTCCCTTGAAC (SEQ ID NO: 947) | 647 bp | slp2 5' flank |
| T1765_slp2_5fprobe_rev | CTGAATCTTGCTGGTCCG (SEQ ID NO: 948) | | |
| T1766_slp2_3fprobe_for | CAGCACATTCCAGATTGGC (SEQ ID NO: 949) | 853 bp | slp2 3' flank |
| T1767_slp2_3fprobe_rev | TGCTCAATGTGGGAGAGAGC (SEQ ID NO: 950) | | | diluted stock (10 µg/ml) made in sodium citrate buffer pH 4.5 was added to each well of supernatant. The casein stock solution from the vial was 1000 µg/ml and initially resuspended in 200 µL of PBS. For each sample a background control was used with 100 µl of diluted supernatant and 100 µl of sodium citrate buffer pH 4.5. The plates covered in plastic bags were incubated at 37° C. The fluorescence from the plates was measured after 2, 3, and 4 hours. The readings were done on a fluorescent plate reader using 485 nm excitation and 530 nm emission.

The protease activity of the supernatant coming from the M1162 strain was extremely low, compared to the M1076 strain. The SLP2 protease activity was seriously affected by switching the slp2 promoter. The resulting protease activity upon casein was 3.6 times lower on day 3 and 2.5 times lower on day 4 (Table 19.3).

TABLE 19.3

Protease activity measurements upon casein substrate for M1076 and M1162 fermentation supernatants. Samples were diluted so that 1 mg/ml of total protein was used per sample. Casein FL substrate was added to measure the protease activity.

| Day | M1076-13 deletions (units) | M1162-14th round (units) |
|---|---|---|
| 2 | 8.8 | 3.0 |
| 3 | 11.6 | 3.6 |
| 4 | 10.5 | 4.2 |
| 5 | 20.2 | 3.7 |

Example 20

Generation of 13-Fold Protease Deletion Strain Expressing IFN-α 2b

The 13-fold deletion strain expressing interferon alpha 2b was created in two steps. First, an interferon producing strain from M893 was generated as described above, which contained 12 protease deletions Δ(pep1 tsp1 slp1 gap1 gap2 pep4 pep3 pep5 pep2 sep1 slp8 amp2). The M893 protoplasts were transformed with pTTv401 (derived from a plasmid having complete cbh1 promoter and cbh1 terminator sequences but lacking CBH1 encoding gene sequence inserted with IFN-α 2B, GGGGG-NVISKR) MssI fragment. The pTTv401 cassette carried the acetamide selection marker and was targeted to cbh1 locus.

M893 transformants were streaked on selection plates and PCR screening for correct integration into cbh1 locus. PCR screenings were done using Phire Plant Direct kit (Thermo Scientific, F-130). Screening primers are listed on Table 43.1. A strain was named M1012.

TABLE 20.1

Screening primers for pTTv401 into M893 transformation.

| | Sequence 5'-->3' | |
|---|---|---|
| 5' integration screening cbh1 locus | | |
| T095_Ann1_12_F_cbhI_Ben | GCTGTTCCTACAGCTCTTTC (SEQ ID NO: 951) | Product ~2.8 kb |
| T096_Ann1_13_R_cbhI_Exon_Ben | AGCCGCACGGCAGC (SEQ ID NO: 952) | |
| 3' integration screening cbh1 locus | | |
| T008_pHHO1-CBHIloc_cbh13'flankOutRev | GGTTGACTTACTCCAGATCG (SEQ ID NO: 953) | Product ~1.9 kb |
| T022_Amds_start_rc_seg | CTGAAGCAACAGGTGCCAAG (SEQ ID NO: 954) | |
| cbh1 ORF screening | | |
| T685_Tdm_11_screen_ | GCCTTTGGGTGTACATGTTTG (SEQ ID NO: 1048) | 871 bp product if CBH1 orf still present |
| T908_CBH1_intron_rev | TGGCCAGTCAGCTGGGAGCC (SEQ ID NO: 955) | |

M1012 was confirmed by Southern analysis to carry one IFN-α 2b expression cassette at cbh1 locus. M1012 spores were plated on 5-FOA plates to loopout pyr4 marker. Colonies were picked and streaked on 5-FOA plates. Single cell plating was done for ten clones and subclones were screened by PCR to confirm pyr4 loopout. Screening primers are listed in Table 20.2. Clones which gave correct signals for pyr4 loopout were streaked on PD plates and +/− uridine plate test was done for selected clones. M1012 pyr4 negative clone 1-1 was named as M1065 and pyr4 negative clone 2-1 was named as M1066.

TABLE 20.2

Primers for screening pyr4 loopout from M1012

*Primer pair 1:*

| | |
|---|---|
| T1556_amp2_5f_f2 | AAGTGTGCTGATGTGATGGA (SEQ ID NO: 956) |
| T1557_amp2_3f_r2 | GCATGCGAAGTACCTTACGA (SEQ ID NO: 957) |

*Primer pair 2:*

| | |
|---|---|
| T061_pyr4_orf_screen_2F | TTAGGCGACCTCTTTTTCCA (SEQ ID NO: 382) |
| T624_gpdA_seqR1 | CTCCATATTCTCCGATGATGC (SEQ ID NO: 852) |

To generate 13-fold protease deletion strain with IFN-α 2b expression, M1065 protoplasts were transformed with MssI fragment of slp2 (tre123244) deletion vector pTTv457 (generated from pTTv115 by introducing/changing pyr4-hygromycin selection marker). Protoplasting and transformation was carried out as above. pTTv457 M1065 transformants were streaked on selection plates and PCR screened for correct integration into slp2 locus. PCR Screening primers are listed on Table 20.3. Three transformants which did not give slp2 ORF signal were streaked on PD+1M sorbitol plates.

TABLE 20.3

Primers for screening slp2 deletion cassette integration and slp2 ORF deletion.

*5′ integration screening*

| | |
|---|---|
| T054_slp2_5screen_F | GATGCACCGCTGCGGCC (SEQ ID NO: 327) |
| T026_Pyr4_orf_5rev2 | CCATGAGCTTGAACAGGTAA (SEQ ID NO: 328) |

*3′ integration screening*

| | |
|---|---|
| T047_trpC_term_end_F | CCTATGAGTCGTTTACCCAGA (SEQ ID NO: 426) |
| T055_slp2_3screen_R | GGCGTTGCTCCCCATGCG (SEQ ID NO: 330) |

*slp2 orf*

| | |
|---|---|
| T1231_slp2_seqF2 | AACGGATCCGGCACCATGTC (SEQ ID NO: 958) |
| T112_slp2_ORF_R | TTACTCGGAGAGCTCAGAGA (SEQ ID NO: 332) |

The best clone was designated M1106 and cultivated with the control strain M961 in a 1 L fermentor in TrMM with 20 g/L yeast extract, 40 g/L cellulose, 100 g/L cellobiose, and 40 g/L sorbose at pH 4.5. The previous standard amount of cellobiose was 80 g/L, so the M961 strain was also cultivated in the control medium (TrMM with 20 g/L yeast extract, 40 g/L cellulose, 80 g/L cellobiose, and 40 g/L sorbose at pH 4.5).

The culture samples were analysed via immunoblotting to quantitate the expression of interferon. The samples were diluted so that 0.05 µl of supernatant could be loaded in 10 µl in a 4-20% criterion page gel. Standard amounts of interferon corresponding to 400, 200, 100, 50, and 25 ng were also loaded to the same gel. The interferon antibody (Abcam #ab9386; diluted to 1 µg/ml in TBST) was incubated with the blot membrane for 1 hour and washed with TBST. The secondary antibody IRDye 680 (Li-Cor #926-68070; diluted 1:30,000 in TBST) was incubated for 1 hour, washed with TBST, and scanned at 700 nm In all the immunoblots interferon was detected as one band about 17 kD. There was a small amount of carrier bound interferon detected about 75 kD, but the majority was in the free form. The M961 strain achieved an interferon production level of 3.2 g/L at 95 hours (Table 20.2). In the presence of higher concentration of cellobiose the interferon production level reached 7.9 g/L at 95 hours and the expression was stable from 89 hours through 99 hours where levels were 7.4 g/L or greater. To check what the maximum production level would be if more proteases were deleted, the M961 strain was grown in the same medium with chymostatin (20 µM) and pepstatin (10 µM) added on days 3-5. The protease inhibitor treatment raised the interferon production level to 10.7 g/L at 140 hours. During M1106 cultivation the expression of interferon was seen from 90 hours up to 121 hours. The highest amount was measured to be 4.3 g/L (Table 20.4). The strain M1106 grew somewhat slower: the M1106 reached 4.3 g/L at 121 hours, whereas the M961 reached 7.4 g/L at 90 hours.

TABLE 20.4

Expression level of interferon alpha 2b detected in the fermentor cultivations in g/L.

| time | M961 (g/L) | M961 (g/L) | M1106 (g/L) |
|---|---|---|---|
| 70.75 h | 2.3 | 3.4 | |
| 89.75 h | 3.1 | 7.4 | |
| 90.4 h | | | 1.1 |
| 95.1 h | 3.2 | 7.9 | |
| 96.4 h | | | 1.7 |
| 99 h | 3.2 | 7.4 | |
| 102.6 h | | | 2.4 |
| 103.75 h | 2.9 | 6.3 | |
| 114 h | | | 3.4 |
| 121.5 h | | | 4.3 |
| cellobiose: | 80 g/L | 100 g/L | 100 g/L |

Example 21

Using CRISPR-CAS System to Generate Gene Deficient Strains of *T. reesei*

Cas9 nuclease sequence with C-terminally tagged nuclear localization signal (nls) is codon optimized for expression in *Trichoderma reesei*. Sequence is cloned under the control of constitutive gpdA promoter and trpC terminator sequences, using basic cloning vector and standard procedures. Final Cas9 nuclease expression vector is constructed from following components: pep4 protease (or any other suitable protease) locus 5' flanking sequence+pgpdA-Cas9-nls-ttrpC cassette+pyr4-hyg$^R$ double selection cassette and pyr4 loop-out sequence+pep4 protease locus 3' flanking sequence. Vector is constructed to pRS426 backbone by utilizing yeast recombination methodology; overlaps between the vector components are generated with PCR primers. Cas9 nuclease expression vector is transformed with peg-mediated protoplast transformation method to wild-type *T. reesei* M124 strain or any other *T. reesei* strain generated above or in WO/2013/174927 or WO/2013/102674, generating simultaneously pep4 protease deletion. Generated strain Cas9_M124 is then used as a background strain for transfection of transient gRNA cassettes generated by PCR, as described in DiCarlo et al. 2013 (Genome engineering in *Saccharomyces cerevisiae* using CRISPR-Cas systems; NAR 41:4336-4343). Alternatively, RNA polymerase III SNR52 promoter- and SUP4 3' flanking region from *Saccharomyces* are replaced with *Trichoderma* homologues.

Guide RNA needed for precise genomic targeting of CAS9 nuclease is located between the promoter and 3' flanking region. Guide RNA is composed of 20 nt's long sequence complementary to desired genomic target, followed by 3 nt's complementary with NGG PAM (protospacer-adjacent motif)—sequence and constant 3' portion required for CAS9 activity. Exemplary guide RNAs are shown in Table 21.1 for various proteases and glycoenzymes harmful for heterologous protein production. The genomic targets are selected among hydrolytic enzymes or enzymes from glycan biosynthesis pathway of *Trichoderma reesei*. Transient guide RNA cassettes (single and multiple) are introduced to Cas9_M124 protoplasts by electroporation or by other basic gene transfer method. Protease deficient clones are selected on the basis of reduced protease activity, caused by CAS9-generated point mutations to desired genomic target sequences. Clones with point mutations targeted to glycan biosynthesis pathway can be selected by glycan profiling. After single spore purification, selected clones are characterized by PCR amplification of genomic target locus and sequencing of the PCR product, to verify the point mutation inactivating the gene.

Figure 19:
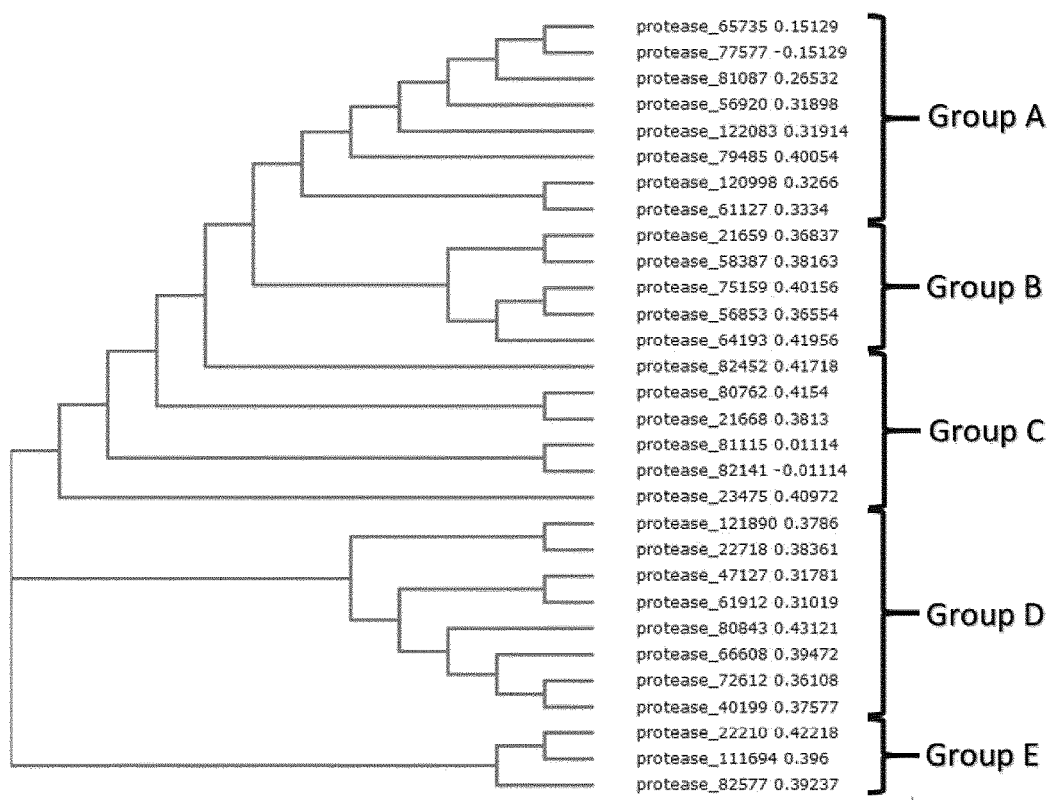
FIG. 19 show a phylogenetic tree of a subset of the proteases amenable to deletions.

Alternative way to produce guide RNA is to express the sequence or multiple sequences from promoter transcribed by RNA polymerase II and flank the guide RNA's with self-processing ribozyme sequences, as described in Gao and Zhao 2014 (Self-processing of ribozyme flanked RNA's into guide RNA's in vitro and in vivo for CRISPR mediated genome editing; Journal of Integrative plant biology, 56:343-349). FIG. 19 show a phylogenetic tree of a subset of the proteases amenable to deletions.

TABLE 21.1

Guide RNA sequences targeted to *T. reesei* proteases and ALG3.

| Enzyme | id | Guide RNA sequence | |
|---|---|---|---|
| pep1 | 74156 | CCCCACCGAGGGTCAGAAGA | (SEQ ID NO: 959) |
| pep2 | 53961 | CACCGTCCTGTCTGCCTCCA | (SEQ ID NO: 960) |
| pep3 | 121133 | TCCAGGCCCAGGCAAAGTTC | (SEQ ID NO: 961) |
| pep4 | 77579 | GTTCAACGACAAGCCGCCCA | (SEQ ID NO: 962) |
| pep5 | 81004 | GCATGCCATTGAGATCAACC | (SEQ ID NO: 963) |
| pep7 | 58669 | CCACGCGCGGCGCCCCAAGC | (SEQ ID NO: 964) |
| pep8 | 122076 | ATTACGTTGCAGCTCGACAC | (SEQ ID NO: 965) |
| pep11 | 121306 | CACCACCTTTGTCGACGCCA | (SEQ ID NO: 966) |
| pep12 | 119876 | GACGCCATCAATAACCTCAC | (SEQ ID NO: 967) |
| pep9 | 79807 | CCCGATGCGCCCAACACCGC | (SEQ ID NO: 968) |
| tsp1 | 73897 | TCGCAGATCCGCGTCCGCGC | (SEQ ID NO: 969) |
| slp | 57433 | ATCTATCTAAGCATTTCGCA | (SEQ ID NO: 970) |
| slp | 35726 | GCTGCCCCTGATGCGACTAT | (SEQ ID NO: 971) |
| slp | 60791 | GTCGACCAACTCCATACTCA | (SEQ ID NO: 972) |
| slp | 109276 | AACGACACCGACATCTTCTA | (SEQ ID NO: 973) |
| slp1 | 51365 | CGCGTACATCTTCGAATTCG | (SEQ ID NO: 974) |
| slp2 | 123244 | CTGAAGCACACTTTCAAGAT | (SEQ ID NO: 975) |
| slp3 | 123234 | CTTGTTCCCACTACCAAGCA | (SEQ ID NO: 976) |
| slp5 | 64719 | ACTCCTTCAGCATGCACACC | (SEQ ID NO: 977) |

TABLE 21.1-continued

Guide RNA sequences targeted to *T. reesei* proteases and ALG3.

| Enzyme | id | Guide RNA sequence |
|---|---|---|
| slp6 | 121495 | AGAAACCGTTAAGCAGATCA (SEQ ID NO: 978) |
| slp8 | 58698 | AACAAGAACAGCACGTTCGA (SEQ ID NO: 979) |
| gap1 | 69555 | GTGATGGCACCTACGATGCC (SEQ ID NO: 980) |
| gap2 | 106661 | GTGCTGCCCGCCGCTCCAAC (SEQ ID NO: 981) |
| gap3 | 70927 | GTCATTGATTCGCCCCCAGA (SEQ ID NO: 982) |
| gap4 | 57575 | CGCGAATTCCCCTCAGACTC (SEQ ID NO: 983) |
| amp1 | 81070 | GAGCTTCTACAAGTTCGCAA (SEQ ID NO: 984) |
| amp2 | 108592 | CCTCGACTCGCGCTTCGTCA (SEQ ID NO: 985) |
| sep1 | 124051 | GCAGCCAGCACTCCCACCTA (SEQ ID NO: 986) |
| slp7 | 123865 | TCTCCGACCCCTCAAGCCCA (SEQ ID NO: 987) |
| tpp1/sed3 | 82623 | GCAGTTCTGCCGTCGAGTCT (SEQ ID NO: 988) |
| sed2 | 70962 | GAGATACCAGCAACGCGCGA (SEQ ID NO: 989) |
| sed5 | 111838 | GATCCTTCATCAGAAACATT (SEQ ID NO: 990) |
| sed3 | 81517 | GCAGCCATATATCGACAGCC (SEQ ID NO: 991) |
| mp1 | 122703 | CAGACGACGACGCTCAAGAA (SEQ ID NO: 992) |
| mp2 | 122576 | GACGCTGCCTCATCTAGTCG (SEQ ID NO: 993) |
| mp3 | 4308 | GCTGCGCGATCTCGACTTCA (SEQ ID NO: 994) |
| mp4 | 53343 | CTCACATTCTCTATTCACGA (SEQ ID NO: 995) |
| mp5 | 73809 | TGTGCTCCTGACCGACAAGC (SEQ ID NO: 996) |
| ALG3 | 104121 | ACTGCCGTGGACATTGCCAA (SEQ ID NO: 997) |
| a protease | 80843 | CAGTCACCAGCAAGACAAAG (SEQ ID NO: 998) |
| a protease | 72612 | CGACCTCCACGATGTCATCA (SEQ ID NO: 999) |
| a protease | 47127 | AAGACGAAGCTCCGCCAATC (SEQ ID NO: 1000) |
| a protease | 77577 | AAGAGCACGACCGTTTCGTC (SEQ ID NO: 1001) |
| pep13 | 76887 | TCTGACGCTGCTCCTCGCGA (SEQ ID NO: 1002) |
| a protease | 56920 | ATCACCGACACGCGAGACCT (SEQ ID NO: 1003) |
| a protease | 120998 | GTCGCTGGCCTCGTCCCTCA (SEQ ID NO: 1004) |
| a protease | 65735 | GAGCTCGTCCGACCCCCGCC (SEQ ID NO: 1005) |
| a protease | 82141 | CCCTGTCCCTGACCTTACAA (SEQ ID NO: 1006) |
| a protease | 121890 | GAAATCACAACACTGCCAAA (SEQ ID NO: 1007) |
| a protease | 22718 | GAACTCAACCTCCAAGACGC (SEQ ID NO: 1008) |
| a protease | 21659 | GAGTATGTTGCCATGTTCCT (SEQ ID NO: 1009) |
| a protease | 82452 | CACGGAGACTGCTGCCGCTC (SEQ ID NO: 1010) |
| a protease | 81115 | CTACTTCACCTACGACATCC (SEQ ID NO: 1011) |
| a protease | 64193 | CATCCTCACCATCCTCACCA (SEQ ID NO: 1012) |
| a protease | 23475 | GCTCTCACGAAATCCTCGAC (SEQ ID NO: 1013) |
| a protease | 79485 | GCTCTCTGAGCCTGCAAGAC (SEQ ID NO: 1014) |
| a protease | 122083 | CCGCGTCTCCTGCACGTAGT (SEQ ID NO: 1015) |

TABLE 21.1-continued

Guide RNA sequences targeted to *T. reesei* proteases and ALG3.

| Enzyme | id | Guide RNA sequence | |
|---|---|---|---|
| a protease | 61127 | TGCGCGACCCCGTCATCGTC | (SEQ ID NO: 1016) |
| a protease | 80762 | ACCTCTCTGGTCCACGACCT | (SEQ ID NO: 1017) |
| a protease | 56853 | GACTCCTCCCTCCACACCGT | (SEQ ID NO: 1018) |
| a protease | 22210 | TCTGTCGAGGAGAGCAACAT | (SEQ ID NO: 1019) |
| a protease | 111694 | ACGCGCAACAACCGCCGCAC | (SEQ ID NO: 1020) |
| a protease | 40199 | GCCCGACCGGTTCAACGTCC | (SEQ ID NO: 1021) |
| a protease | 75159 | TTCGACAAGCTCACTTACAA | (SEQ ID NO: 1022) |
| a protease | 21668 | CTTCGACTCCCACTCCAAGA | (SEQ ID NO: 1023) |
| a protease | 61912 | CGCCGCTGCCCTCTTCGAAA | (SEQ ID NO: 1024) |
| a protease | 58387 | CGTCACAGAGCACTTCTTCC | (SEQ ID NO: 1025) |
| a protease | 82577 | CAGCACGACTCCATCTACGC | (SEQ ID NO: 1026) |
| a protease | 81087 | AACCACATCGCCGAGAACAA | (SEQ ID NO: 1027) |
| pep10 | 78639 | CCTTGTCTATGCGAATGACC | (SEQ ID NO: 1028) |
| pep16 | 110490 | AGCAGCAGCAGCACGAGCAG | (SEQ ID NO: 1029) |
| pep14 | 108686 | TCCACGTTTGAGCTGCGTGT | (SEQ ID NO: 1030) |
| pep6 | 68662 | ATCCCCATCCACCAGAAGCG | (SEQ ID NO: 1031) |
| a protease | 66608 | CGTCTTCGACCGAATACAAG | (SEQ ID NO: 1032) |

Example 22

Transcriptome Analysis with *Trichoderma reesei* Strains M629 and M507

*Trichoderma reesei* strains M629 (MAB01, pcDNA1-(Kre2)huGnt1, pgpdA-(nat)huGnt2, Δpep1 tsp1 slp1 gap1 gap2 pep4 pep3) (as described in Example 19 of WO2013/102674) and M507 (MAB01, Δpep1 tsp1 slp1 gap1 gap2 pep4 pep3) (as described in Example 6 of WO2013/102674) were cultivated in fermentor with standard Yeast extract— and Spent grain extract culture medias. Total RNA was purified with standard methods, from samples collected on days 1, 3 and 4 (Yeast extract media) and on days 1, 3 and 5 (Spent grain extract media). mRNA was purified from total RNA samples with Machery-Nagel nucleotrap mRNA kit according to Kits instructions. Conversion to cDNA and preparing for sequencing was made with Illumina TruSeq Stranded mRNA Sample Prep Kit. 250-450 base pare products were collected for sequencing, with Illumina hiScanSQ sequencer (100+8(index)+100 cycles, paired end run).

For statistical analysis the sequence reads were manipulated as following. The 9134 gene reads originating from the sequencing were cleaned (i.e. genes with all values with zero or average all over conditions below 0.1 were removed) and this resulted 8525 gene reads. Of the 8525 genes potential protease genes were identified based on sequence similarity to other identified *Trichoderma* proteases or the ones of other filamentous fungi (*Aspergillus*, *Neurospora*). The following proteases either show constant or regulated expression levels in different time points and/or culture conditions (based on FPKM values; fragments per kilobase of exon per million fragments mapped) and should therefore be deleted: a metalloprotease mp1 (TR122703), a protease (TR80843), a peptidase (TR72612), a protease (TR47127), a peptidase (TR77577), pep13 (TR76887), a protease (TR56920), a carboxypeptidase (TR120998), a protease (TR65735), a peptidase (TR82141), a metalloprotease (TR121890), a peptidase (TR22718), a peptidase (TR21659), mp5 (TR73809), a protease (TR82452), a peptidase (TR81115), a peptidase (TR64193), a protease (TR23475), a peptidase (TR79485), mp3 (TR4308), a protease (TR122083), a carboxy peptidase (TR61127), a peptidase (TR80762), a peptidase (TR56853), a peptidase (TR22210), a protease (TR111694), mp4 (TR53343), mp2 (TR122576), a protease (TR40199), a protease (TR75159), amp2 (TR108592), a protease (TR21668), amp1 (TR81070), a protease (TR61912), a protease (TR58387), a protease (TR82577), a protease (TR81087), pep10 (TR78639), pep16 (TR110490), pep7 (TR58669), pep14 (TR108686), pep6 (TR68662) and a protease (TR66608).

Example 23

Generation of mp1 or mp5 Deletion Strains

The deletion plasmid pTTv468 for the metalloprotease mp1 (tre122703) was constructed using yeast homologous recombination. The plasmid has mp1 3' direct repeat for looping out the pyr4 marker. A NotI digested plasmid (from a plasmid with hygr-pyr4 double marker derived from plasmid pTTv194) was used as backbone. mp1 3' direct repeat and pyr4 marker were constructed by PCR using oligos listed in Table 23.1. pTTv468 vector was assembled using yeast homologous recombination cloning as described above.

TABLE 23.1

Primers used for cloning deletion vector pTTv468 for mp1 (tre122703).

| | |
|---|---|
| T1731 | CAGCGTCGAAAGATTTCATCAAACCGCTCAATT GACCATCGCGGCCGCGATGCGAAGCGAATGGAG CA (SEQ ID NO: 1033) |
| T1732 | GCGCTGGCAACGAGAGCAGAGCAGCAGTAGTCG ATGCTAGGGCGCGCCTATACCTCACAATAGACG GA (SEQ ID NO: 1034) |
| T1369_pyr4_for | CTAGCATCGACTACTGCTGC (SEQ ID NO: 1035) |
| T1733 | TTTTCAGACAAGTCCGCCCCTGCTCCATTCGCTT CGCATCGCGGCCGCGGCGCGCCATGCAAAGATAC ACATCAAT (SEQ ID NO: 1036) |

To generate a 15-fold protease deletion strain, the 14-fold protease deletion strain M1199 (pyr4– of M1162) was transformed with MssI fragment of pTTv468. Transformation was carried out using standard protoplast transformation method for pyr4 selection. Colonies growing on transformation plates were being picked on selective plates and screened for correct integration of the deletion cassette using primers shown in Table 23.2.

TABLE 23.2

Primers used for screening.

| | |
|---|---|
| T1100_mp1_screen_5flk_fwd | GTCTTGGCCATCAATGGAGT (SEQ ID NO: 1037) |
| 488_pyr4_5utr_rev | GGAGTTGCTTTAATGTCGGG (SEQ ID NO: 428) |
| T061_pyr4_orf_screen_2F | TTAGGCGACCTCTTTTTCCA (SEQ ID NO: 382) |
| T1101_mp1_screen_3flk_rev | ACGGCTTACGAACAACGAGT (SEQ ID NO: 1038) |
| T1102_mp1_orf_fwd | ACATCCTGGCCGATATTCTG (SEQ ID NO: 1039) |
| T1103_mp1_orf_rev | GCTGTAGCTGGTGGAGAAGC (SEQ ID NO: 1040) |

The deletion plasmid pTTv469 for the metalloprotease mp5 (tre73809) was constructed using yeast homologous recombination. The plasmid has mp5 3' direct repeat for looping out the pyr4 marker. mp5 3' direct repeat and pyr4 marker were constructed by PCR using primers listed on Table 23.3.

TABLE 23.3

Primers used for cloning deletion vector pTTv469 for mp5 (tre73809).

| | |
|---|---|
| T1668_mp5_3DR_fw | TTGCAAGTCGGACTCTGGACGCTTCGTGAA ATCCCCCGCAGCGGCCGCACATTAGAGCTC TCTCCTCC (SEQ ID NO: 1041) |
| T1669_mp5_3DR_rev | GCGCTGGCAACGAGAGCAGAGCAGCAGTAG TCGATGCTAGGGCGCGCCTACGGCTGTCAC AATGCACA (SEQ ID NO: 1042) |
| T1369_pyr4_for | CTAGCATCGACTACTGCTGC (SEQ ID NO: 1035) |
| T1734 | TACCCAGACGTAGAGAAGGAGGAGGAGAGA GCTCTAATGTGCGGCCGCGGCGCGCCATGC AAAGATACACATCAAT (SEQ ID NO: 1043) |

To generate another 15-fold protease deletion strain, the 14-fold protease deletion strain M1199 (pyr4– of M1162) was transformed with MssI fragment of pTTv469. Transformation was carried out using standard protoplast transformation method for pyr4 selection. Colonies growing on transformation plates were being picked on selective plates and screened for correct integration of the deletion cassette using primers shown in Table 23.4.

TABLE 23.4

Primers used for cloning deletion vector pTTv469.

| | |
|---|---|
| T1677_mp5_5fl_int_Fw | GAACCAGCGCTCCAATACCT (SEQ ID NO: 1044) |
| T488_pyr4_5utr_rev | GGAGTTGCTTTAATGTCGGG (SEQ ID NO: 428) |
| T061_pyr4_orf_screen_2F | TTAGGCGACCTCTTTTTCCA (SEQ ID NO: 382) |
| T1678_mp5_3fl_int_rev | GGGCTGTGTGTGTGTGTTTG (SEQ ID NO: 1045) |
| T1675_mp5_orf_f | GCCTGGTCGATACTGCTCTC (SEQ ID NO: 1046) |
| T1676_mp5_orf_r | CCTGTTGGGTATGAAGGCGT (SEQ ID NO: 1047) |

Example 47

Generation of 13-Fold Protease Deletion Strain with slp3 Deletion

To generate a 13-fold protease deletion strain with Δslp3, the 12-fold protease deletion strain M901 (pyr4– of M893) was transformed with MssI fragment of pTTv425. Transformation and screening of the clones were performed as described above. One original transformant was obtained and after three purification rounds clones were rechecked by PCR (see Table 6-1). A subclone was named as M1075.

SEQUENCE LISTING (1048 sequences)

SEQ ID NO: 1 - protein, 407 aa, Trichoderma reesei
MQTFGAFLVSFLAASGLAAALPTEGQKTASVEVQYNKNYVPHGPTALFKAKRKYGAPISDNLKSLVAARQAKQALAKRQTGSAPNHPSDSADSEYITSVSIGTPAQVLPLDFDTGSSDLWVFSSETPKSSATGHAIYTPSKSSTSKKVSGASWSISYGDGSSSSGDVYTDKVTIGGFSVNTQGVESATRVSTEFVQDTVISGLVGLAFDSGNQVRPHPQKTWFSNAASSLAEPLFTADLRHGQNGSYNFGYIDTSVAKGPVAYTPVDNSQGFWEFTASGYSVGGGKLNRNSIDGIADTGTTLLLLDDNVVDAYYANVQSAQYDNQQEGVVFDCDEDLPSFSFGVGSSTITIPGDLLNLTPLEEGSSTCFGGLQSSSGIGINIFGDVALKAALVVFDLGNERLGWAQK

SEQ ID NO: 2 - protein, 404 aa, Hypocrea lixii
MQTFGAFLVSFLAASGMAAALPTEGQKTASIEVAYNKNYVAHGPTALFKAKRKYGAPISDNLRAAVAAKHSLTKRQTGSANTNPSDSADDEYITSVSIGTPAQVLPLDFDTGSSDLWVFSSETPKSSASGHALYSPSKSSTAKKLSGSTWSIEYGDKSSSSGDVYTDIVTIGGFSVKTQAVESATKVSTQFVQDTVISGLVGLGFDIGNQVSPRPQKTWFSNAASSLAEPLFTADLRHQETGSYNFGFIDTSLAKGTIGYTPADGSEGYWGFTATGYSVGGAKLNRNSITGIADTGTTLLLLPDNIVDAYYNNVESAQYDDSQEGVVFDCSEDLPSFSFGVGGQTITISGDLLNLTPIEEGSSTCFGGLQSSADIGINIFGDVALKAALVVFDLGNERLGWAQK

SEQ ID NO: 3 - protein, 405 aa, Trichoderma asperellum
MQTFGAFLVSFLAASGMAAALPAEGQQKTISVPVIYNANHAPHGPSALYKAKKKFGAPISESLKNNVAQHKAAKLARRQTGSAPNHPSDSEDDEYITNVSIGTPAQVLPLDFDTGSSDLWVFSSETPSSQAKGHTLYNPTKSSTSKKLSGYSWTISYGDGSSSSGDVYTDTVSVGGFSVTGQAVESATKVSSEFVSDTSNSGLLGLALDSINTVSPKQQKTWFSNASSKLAQPVFTADLNHQASGSYNFGYIDTSLASGPISYVPISTANGFWEFTSASYAIGSGSTKKHSTDGIADTGTTLLLLDDTIVDAHYGQVSSAQYDNSQEGYTFDCDENLPSFTFAVGSSKITVPGSLINFAPVSGNTCFGGLQSNDGIGINIFGDVAIKAALVVFDLGNKRLGWAQK

SEQ ID NO: 4 - protein, 405 aa, Trichoderma atroviride
MQTFGAFLVSFLAASGLAAALPAEGQQKTISVPVKYNANHAPHGPTELFKAKRKFGAPISENLKNRVAEHKAAKLARRQTGSAPNHPSDSEDDEYITNVSIGTPAQVLPLDFDTGSSDLWVFSSETPSSSARGHTIYTPSKSSTSKKVSGASWSITYGDNSSSSGDVYTDTVTIGGFSVTGQAVESATKVSTQFVQDTSNSGLVGLALDSGNTVKPTKQKTWFSNASSHLAQPVFTADLNHQADGSYNFGFIDTTLASGPITYVPISTGNGFWEFTSASYAIGGGSSKKHSTDGIADTGTTLLLLDDTIVDAYYNQVESAQYDDSQEGYTFDCSEDLPSFSFAVGSSTITVPGSLINFAPVDGNTCFGGLQSDDGIGISIFGDVAIKAALVVFDLGNKRLGWAQK

SEQ ID NO: 5 - protein, 404 aa, Trichoderma virens
MQTFGAFLVSFLAASGLAAALPAEGQKTASIEVSYNKHYVPHGPTALFKAKRKYNAPISEKLHAAVAAKKALTKRQTGSANTNPSDSADDEYITNVSIGTPAQVLPLDFDTGSSDLWVFSSETPKSSASGHVTYSPSKSSTAKKLSGASWSITYGDHSSSSGDVYTDKVTVGGFSVSSQAVESATKVSTQFVQDTVISGLLGLGFDVGNTVKPRAQKTWFSNAANSLAQPLFTADLKHQQTGSYNFGFIDTTLAKGPIGYTPADGSEGYWGFTATGYSVGGAKLNRNSITGIADTGTTLLLLDDDVVNAYYNNVESAQYDDSQQGVVFDCSEDLPSFSFGVGGTTITIPGSLINLTPVSDGSSTCFGGLQSSADIGINIFGDVALKAALVVFDLGNERLGWAQK

SEQ ID NO: 6 - protein, 395 aa, Aspergillus fumigatus
MVVFSKVTAVVVGLSTIVSAVPVVQPRKGFTINQVARPVTNKKTVNLPAVYANALTKYGGTVPDSVKAAASSGSAVTTPEQYDSEYLTPVKVGGTTLNLDFDTGSADLWVFSSELSASQSSGHAIYKPSANAQKLNGYTWKIQYGDGSSASGDVYKDTVTVGGVTAQSQAVEAASHISSQFVQDKDNDGLLGLAFSSINTVSPRPQTTFFDTVKSQLDSPLFAVTLKYHAPGTYDFGYIDNSKFQGELTYTDVDSSQGFWMFTADGYGVGNGAPNSNSISGIADTGTTLLLLDDSVVADYYRQVSGAKNSNQYGGYVFPCSTKLPSFTTVIGGYNAVVPGEYINYAPVTDGSSTCYGGIQSNSGLGFSIFGDIFLKSQYVVFDSQGPRLGFAPQA

SEQ ID NO: 7 - protein, 404 aa, Aspergillus oryzae
MVILSKVAAVAVGLSTVASALPTGPSHSPHARRGFTINQITRQTARVGPKTASFPAIYSRALAKYGGTVPAHLKSAVASGHGTVVTSPEPNDIEYLTPVNIGGTTLNLDFDTGSADLWVFSEELPKSEQTGHDVYKPSGNASKIAGASWDISYGDGSSASGDVYQDTVTVGGVTAQGQAVEAASKISDQFVQDKNNDGLLGLAFSSINTVKPKPQTTFFDTVKDQLDAPLFAVTLKYHAPGSYDFGFIDKSKFTGELAYADVDDSQGFWQFTADGYSVGKGDAQKAPITGIADTGTTLVMLDDEIVDAYYKQVQGAKNDASAGGYVFPCETELPEFTVVIGSYNAVIPGKHINYAPLQEGSSTCVGGIQSNSGLGLSILGDVFLKSQYVVFDSQGPRLGFAAQA

SEQ ID NO: 8 - protein, 407 aa, Metarhizium anisopliae
MQTFGSFLVSLVVASSLATALPTTPSSTPAGNVSVTAKHNANFTRNGPAALAKAYRKFGKPVPVDVANALSRQNSKRTTGSDPNSPQQYDIEYLAPVQIGTPAQTLNLDFDTGSSDLWVFSSLTPSSQVNGQTLYNPSKSSTAQSLSGSTWSITYGDGSSSSGVVYTDAVTVGGLTVNAQAVEAAKQVSSQFSQDAASSGLLGLAFSSINTVKPTKQKTFFDNAKPALDSALFTADLKHGADGKYNFGYIDSTAYTGSIAYTPVDSSQGFWGFTSRGYAVGGGSLNTASTSGIADTGTTLLLLPSSIVSAYYAKVSGARYDSSQGGYTFACSQSLPSFSFGVSGATVTVPGAYLNYAPTDSTGRTCFGGLQSSSGIGINIFGDVALKSAFVVFDGGNNRLGWAAKAL

SEQ ID NO: 9 - protein, 406 aa, Gibberella zeae
MPSLNALLSASLAFASIALGAPAVQDKHFSVEQVKNPQFVKNGPLALAHVYAKYGVPLPKGLEKAVQKVKSSHTKRQNGSGSVITTPQDEDIEWLTPVQIGTPAQTLNLDFDTGSSDLWVFSTETSGSSGHDEYNPAKSSTSKKLSGATWSISYGDGSTSSGDVYKDKVSVGGLVVSSQAVESAQRVSDQFEQETGLDGLLGLGFSSINTVTPTQQNTFFDNAAPSLQSAVFTANLKHQKPGTYNFGFIDSSSYTGKIGYAPVDSSQGFWEFTASGYAVGSATVNRSPITGIADTGTTLLLLPSAINSAYYAKVSGARYSSSYGGYVFSCSATLPNFSFAVGGVTITIPGSYINYAPVQDGSSTCLGGIQPSEDIGINIFGDIALKAAFVVFDGGNQQVGWAKKTL

SEQ ID NO: 10 - protein, 407 aa, Fusarium venenatum
MPSLNALLAASLAFASIALGAPAVQDKHFSVEQVKNPKFIKSGPLALAHVYSKYGVPLPKGLEKAVKAVKSSSHSKRQNGSGSVITTPADEDIEWLTPVQIGTPAQTLNLDFDTGSSDLWVFSTETSGSSGHDEYNPAKSSTSKKLAGATWSISYGDGSTSSGDVYKDKVSVGGLAVASQAVESAQRVSDEFEQETGLDGLLGLGFSSINTVKPTKQKTFFDNAISTLQSPVFSADLKHQQPGTYNFGYIDSSAYTGKIGYAPIDSSGGWWEFTSSGYAVGSAALNKSPITGIADTGTTLLLLPDAVNSAYYAKVSGARYSSSYGGYVFSCSATLPNFSFAVGGVTITIPGSYINYAPVQQGSSTCLGGIQPSDDIGINIFGDIALKAAFVVFDGGNQQVGWAKKTL

SEQ ID NO: 11 - protein, 414 aa, Fusarium oxysporum
MPSINALLTASLAFASIALGAPAAQDKKFTVEQVKNPKFIKNGPLALAHVYAKYGVPLPKGLEKAVKAVRPPHAHSKRQSGSGSATTTPSDEDVEWLTPVQIGTPAQTFNLDFDTGSSDLWVFSTETTGSSGHDEYNPAKSSTAKKLSGATWKISYGDGSSSSGDVYKDKVSVGGLVVSSQAVEAAQKVSSEFEQETGLDGLLGLGFSSINTVTPTQQKTFFDNAASTLGSPVFTADLKHQKPGKYNFGFIDSTAYTGKIGYASVDSSEGFWEFTSTGYGIGSAAVNKSPITGIADTGTTLLLLPDDVNSAYYAKVSGARYSSSYGGYVFSCSATLPSFSFVVGGVTITIPGSYINYAPVQDGSTTCLGGIQPSDDIGINIFGDIALKAAFVVFDGGNQQVGWAKKTLLSLVDS

SEQ ID NO: 12 - protein, 410 aa, Grosmannia clavigera
MPSTTFLTVALAAVSAVSAMPARIGVPVSTSNFSIHQVRNEQFTGHHGPLALAKAYRKYGVALPTDLEAAVAKIQADQAVSRRDTGSATNTPTSDDSEYLTPVQIGTPAQTLHLDFDTGSSDLWVFSTETPSGSVDGQTLYKPASSSSSEKLTGATWKIKYGDDSTSSGDVYTDVVSVGGLSVQSQAVESAKTVSSSFTSDTASSGLLGLAFSSINAVLPDQQNTFFDNAQDSLDSALFTVDLKHGKAGKYNFGYIDSAAHTGSITYTDVDNAKGFWGFTADGYKIGNAAKKGTSISGIADTGTTLLLLPDAVVDAYYAGVSGASYDSSQGGYTFPSSATLPAFTYYVEGVAFTVPASYIKYAAIDSSTYFGGIQSDSSIGFSIFGDVALKAAFVIFDATPKLGFAPKTL

SEQ ID NO: 13 - protein, 411 aa, Verticillium albo-atrum
MQTFGTFFVAILAATGYAAVVPTKIGIPDQGTFSVRAVPNPGFQHRNGAIALAKAYNKFGKAAPADVAAAAANATESRLSKRTTGSATTSPEANDVEYLTPVQIGTPAQNLVLDFDTGSSDLWVFSTELPSSQVNGQTRYNPASSSTSSKVAGAKWSISYGDGSSSNGDVYLDKVTIGGLTVKKQAVEAAQKVSSSFTSDPLDGLLGLAFSSINTVSPSRQLTFFDNAKSTLDAPLFTADLKHAADPAGKYNFGYIDKTAYKGAITYTNVDNSDGFWSFTSTGYQVGTAAFKSSPVTGIADTGTTLLLLPTSVVSAYYAQVSGARYDSSQGGYVFSCSATLPAFTFGVESARIKIPGSYINFAPVDDSGSVCFGGIQRNTNIGFSIFGDVALKAAFVVFNGGDLTLGWASK

SEQ ID NO: 14 - protein, 421 aa, Chaetomium globosum
MRFFSALLAVTSVASVFARALPPFSPSTGADRRGAFSVKQVRNLNFVRSGPVQLAKIYHKYHAPLPDDLKAAVSRIRSNTLKRSNGTVETNPEANDVEYLTPVSIGTPEQVLNLDFDTGSSDLWVFSSQTKNSEVDGQTVYNPTKSSTAKELKGYTWQISYGDGSYSGGNVYTDTVTVGGLAVPSQAVEVATQVSDEFTSDPNNDGLLGLGFSSINTVEPKSQKTFFDNAMPNLDSPLFTADLKASVPGHFTFGYINPDAYIGNITYTPVDSSGGFWAWKSSGYAVGSGSFKTTTFQGIADTGTSLLLLPSSVVSAYYRQVRNATYDSTQGGYTLPCSGPVPDFAFGVGDKDTMITVPGDYITYAPTSSSGETCFGGIQPDTGIGISIYGDVALKAAFVVFDGGNMQLGWASKTLPLSTGP

SEQ ID NO: 15 - protein, 439 aa, Neurospora crassa
MVALTNLLLTTLLASAGLGAALPPRIGSTVIEAREPELPVSGRKITLPQQKNPRFHKFNGALSVYKTYLKYGAPVPDHLVQAVANHLGISVEEVHNYANTTANARRDQGSATAAPIDQSDSAYITPVSIGTPAQTLNLDFDTGSSDLWVFSNSLPSSQRAGHTIYNPSKSSTAKRVNGASWDISYGDGSSSKGQVYLDKVTIGGLVVSNQAVETAQQVSQSFTAETSIDGLVGLAFGSLNTVRPRQQKTWFENAIGQLDQPLFAADLKYEASGTYDFGFIDPAKHTGDITYVPVNTNPGYWTWTSTGYQVGSSPFVSQSITNIADTGTTLMYVPDSILRAYYGQIRGATNSQSYGGYVFPCSTEAPDFTFGVTDEATITIPGRFINYGPVTDDGETCFGGLQTSSDVGINIFGDVALKAAYVVFKGGDSPSLGWASKQL

SEQ ID NO: 16 - protein, 430 aa, Neurospora tetrasperma
MLLFPTILTAALAATGMAAAIPSRDDTTANKGTASLLQVRNPSFEFRHGPLALAKAYQKFGAPMPEDLRAAIARFRQNQKRTTGTIATDPEKHDVEYLTPISVGTPSQDLMVDFDTGSSDLWVFSTEMSTSDIKGQTVYDPNNSSTSEKVQGSTWKITYGDGSSSSDDVYLDTVTIGNLTVPNQAVEAAKKVSSEFTDDSHNDGLLGLGFSAINAVEPTPQNTFFDNIKGSLDAPLFTVDLKHGTPGSFNFGYIDPTAYIGNISWTPVDSSQGYWGFTSPGYAVGTGAFRNHSMSGIADTGTTLLLLPKSVVSAYYKEIQGAQYDSDQGGYIFPCSPTPPDFVFGVNNGIVTVPGDMVSYAPADSANQNCFGGIQKDTGIGFSIFGDVALKTSFVHLHSSIVPGHYADCDMRFNRMLRSYLVDFSSSGPL

SEQ ID NO: 17 - protein, 452 aa, Trichoderma reesei
MEAILQAQAKFRLDRGLQKITAVRNKNYKRHGPKSYVYLLNRFGFEPTKPGPYFQQHRIHQRGLAHPDFKAAVGGRVTRQKVLAKKVKEDGTVDAGGSKTGEVDAEDQQNDSEYLCEVTIGTPGQKLMLDFDTGSSDLWVFSTELSKHLQENHAIFDPKKSSTFKPLKDQTWQISYGDGSSASGTCGSDTVTLGGLSIKNQTIELASKLAPQFAQGTGDGLLGLAWPQINTVQTDGRPTPANTPVANMIQQDDIPSDAQLFTAAFYSERDENAESFYTFGYIDQDLVSASGQEIAWTDVDNSQGFWMFPSTKTTINGKDISQEGNTAIADTGTTLALVSDEVCEALYKAIPGAKYDDNQQGYVFPINTDASSLPELKVSVGNTQFVIQPEDLAFAPADDSNWYGGVQSRGSNPFDILGDVFLKSVYAIFDQGNQRFGAVPKIQAKQNLQPPQ

SEQ ID NO: 18 - protein, 454 aa, Trichoderma atroviride
MEAIFNVQSKFALERGLSKIKAIRNENYKRHGTKSYVYLLNRFGFEPTKPGPYFQGASFHQRGLAHPDFHEARGGRVHKKKHLKKKQTPEGATDPNGTETGEVGAEDQQNDSEYLCEVTIGTPGQKLLLDFDTGSSDLWVFSTELSKSLQSNHTVFNPKNSSTFKALTGQKWQISYGDGSSASGDCGSDDVTVGGLTIKNQTVELASTLAQQFAQGTGDGLLGLAWPSINTVTTNGKPTPANTPVANMITQEDVPSESELFTAAFYSERDANAQSFYTFGYIDQDLVTASGQQIAWTDVDNSQGFWMFPSTSSSVNGKAISQSGNSAIADTGTTLALVSDDVCDALYKAIPGAKYDDQQQGYVFPMSTDVSSLPEFKVSVGNTQFVIQPEDLAFAPADNNNWYGGVQSRGDNPFDILGDVFLKSVYAIFDQGNQRFGAVPKIQATQNLNPPSNQ

SEQ ID NO: 19 - protein, 453 aa, Trichoderma virens
MEAIFQAQAKFRLDRGLTKVKAIRNQNYKRHGTKSYVYLLNRFGFEPTKPGPYYQQHRIRQRGLAHPDFHAPVGGRVHHTKHLHKKVNKHGAPDATGTETGEVGAEDQQNDSEYLCEVTIGTPGQTLLLDFDTGSSDLWVFSTELSKTIQKGHSVFQPTSSSTFKKLPNQAWQISYGDGSSASGDCGSDNVTIGGLTIKNQTVELASKLAQQFAQGTGDGLLGLAWPAINTVATNGKSTPANTPVANMITQDDIPSDAELFTAAFYSERDANAQSFYTFGYIDTDLVSSSGQDIAWTDIDNSQGFWMFPSTSTSVNGKAISQSGNSAIADTGTTLALVSDEVCEALYNAIPGATYDDQQQGYVFPQSTDVSSLPEFKVSVGDTQFVIQPEDLAFAPADDNNWYGGIQSRGTNPFDILGDVFLKSIYAIFDQGNQRFGAVPKIQASQNLSSSAQ

SEQ ID NO: 20 - protein, 454 aa, Hypocrea lixii
MEAIFQAQAKFRLDRGLHKITAIRNKNYKRHGTKSYVYLLNRFGFEPTKPGPYFQEHRVHQRGLVHPDYNAPVGGRVHITKALHKKKNHHGALDANGSEKGEVGAEDQQNDSEYLCEVTIGTPGQKLLLDFDTGSSDLWVFSTELSKSLQKNHTIFNPSESSTFKKLSGQTWQISYGDGSSASGDCGSDNVTIGGLTIKNQTVELASKLAAQFAQGTGDGLLGLAWPSINTVATNGRSTPANTPVANMITQDDVPSNAELFTAAFYSERDANAESFYTFGYIDQDLVTASGQDIAWTDVDNSQGFWMFPSTSSSVNGQAISQSGNSAIADTGTTLALVSDEVCDALYKAIPGATYDDQQQGYVFPMSTDVSSLPEFKVSVGDTQFVIQPEDLAFAPADDNNWYGGVQSRGSNPFDILGDVFLKSVYAIFDQGNQRFGAVPKIQATQNLDSSSAQ

SEQ ID NO: 21 - protein, 454 aa, Trichoderma asperellum
MEAIFNVQTKFRLERGLSKIRAIRNENYKRHGTKSYVYLLNRFGFEPTKPGPYFQGVQFHQRGLAHPDFHEARGGRVHKKKHLRKKVTPEGSTDPNGTETGEVGAEDQQNDSEYLCEVTIGTPGQTLLLDFDTGSSDLWVFSTELSSTIQKGHTVFNPKNSSTFKALTGQKWQISYGDGSSASGDCGSDNVTVGGLTIKNQTVELASTLAQQFSQGTGDGLLGLAWPSINTVTTDGKPTPANTSRCQHITQDDVPSEAQLFTAAFYSERDANAQSFYTFGYIDNDLVTASGQDIAWTDVDNSQGFWMFPSTSSSINGKAISQSGNSAIADTGTTLALVSDEVCDALYKAIPGAKYDDQQQGYVFPMSTDVSSLPEFKVSVGDTQFVIQPEDLAFAPADNSNWYGGVQSRGNNPFDILGDVFLKSVYAIFDQGNQRFGAVPKIQATQNLNSSSNQ

SEQ ID NO: 22 - protein, 426 aa, Aspergillus niger
MATKIKLIPNLNYKRSGTKSYVHLMRKYRFHPTKPGPYTLSSSIQQTGRPYTEKPIGGRAHIRQLVRKKSTTSDEVGEVPAEDVQNDSMYLATVGIGTPAQNLKLDFDTGSADLWVWSNKLPSTLLSENKTHAIFDSSKSSTFKTLEGESWQISYGDGSSASGSVGTDDVNIGGVVVKNQAVELAEKMSSTFAQGEGDGLLGLAFSNINTVQPKSVKTPVENMILQDDIPKSAELFTAKLDTWRDTDDESFYTFGFIDQDLVKTAGEEVYYTPVDNSQGFWLFNSTSATVNGKTINRSGNTAIADTGTTLALVDDDTCEAIYSAIDGAYYDQEVQGWIYPTDTAQDKLPTVSFAVGEKQFVVQKEDLAFSEAKTGYVYGGIQSRGDMTMDILGDTFLKSIYAIFDVGNLRFGAVQREELRQSLKSE

SEQ ID NO: 23 - protein, 459 aa, Aspergillus fumigatus
MSSCRFSNTLKTATASPCKYLHTTTTITMATRIKLLPNPHYRKSGTKSYVHLMRKYRFTPTKGGRYFLSSSLHQTGRQYTHLPVGGRARIQHVLRKRIADTDETSDVGADDVQNDTMYLAPVSIGTPAQTIHLEVDTGSADLWVWSTHLAPATIAQHKTGTVFDPSKSSTFEEQSGSTWKISRDDGSFAFGTVGTDTISLGGLRVEHQAIELADSLSAQYEQGTGDGLLGLAFSHINTVRPQPVRTLVENMVAQEDIPESAKLFTAKLGCWQGANEPDEGEPFFTFGFIDQDIVTASGEEVYYTPIDNSRGFWLFDSASATVNGKTIARSGNKAIADTGTPLALVDDETCQAIYDAIPGAHYDDESQGYIFPSTTTADKLPVVSLAVGDKQFVVQREDLGFAEAKSGYVYGGIQSRGSMAMDILGSTFLKGIYPIFDVGNLRFGAVQRKELHQNLSAPQ

SEQ ID NO: 24 - protein, 393 aa, Aspergillus niger
MRKYRFHPTKPGPYTLSSSIQQTGRPYTEKPIGGRAHIRQLVRKKSTTSDEVGEVPAEDVQNDSMYLATVGIGTPAQNLKLDFDTGSADLWVWSNKLPSTLLSENKTHAIFDSSKSSTFKTLEGESWQISYGDGSSASGSVGTDDVNIGGVVVKNQAVELAEKMSSTFAQGEGDGLLGLAFSNINTVQPKSVKTPVENMILQDDIPKSAELFTAKLDTWRDTDDESFYTFGFIDQDLVKTAGEEVYYTPVDNSQGFWLFNSTSATVNGKTINRSGNTAIADTGTTLALVDDDTCEAIYSAIDGAYYDQEVQGWIYPTDTAQDKLPTVSFAVGEKQFVVQKEDLAFSEAKTGYVYGGIQSRGDMTMDILGDTFLKSIYAVSALLLALRGDIEAH

SEQ ID NO: 25 - protein, 439 aa, Cordyceps militaris
MEAFFQAQAKFQASPGLTKVRAKPNQNYKRHGTKSYVYLLNRFGFEPTKPGPYRRVSHLQQRGLAQSHVAVGGRAAVTSRLAKTLDAAGTQTGEVTAEDQQNDSEYLCEVSIGTPPQKVLLDFDTGSSDLWIFSTELSKATQKGHTIFNPSKSSTFKKLPGQTWQISYGDGSSASGDCGSDNVTIGGLTIEGQTVELASKLAAQFAQGTGDGLLGLAFPAINTVKKNGQPAPAQTPVANMMTQGDIPKQSQLFTSAFYSERDADGPQSFYTFGYVDEALVKASGKDIAWTKIDSSEGFWMFPSASVSIAGKKLALDGNTAIADTGTTLALVSDEVCDALYKAIPGAKYDAQQQGYVFPLTTKPEDLPAFEVAAEDLAFAQADDKNWYGGVQSRGSNPFDILGDAFLKSVYAIWDQGNQRFGAVPKIEKTQNLTAKAQSQ

SEQ ID NO: 26 - protein, 447 aa, Glomerella graminicola
MQAFFQAQAKFKADNGLAKIPVVPNKNYNRHGRKSYVHLLNKFKFEPTKPGPYVQTRRMAQRGLAAPGFNAPVGGRVSMSKVLVKKTEGDQHGEVTAEDQQYDSMYLCEVSIGTPPQKFKLDFDTGSSDLWVFSKELSSSLQRNHNVFDPSKSSTFKKLEGKTWKISYGDGSSASGDCGTDNLVLGGLTVKNQVTELAAHLAPQFSQGTGDGLLGLAFSSINTVQNKGGARDPQATAVDNMIAESDIPKDAELFTSAFYSERDESKPRSFYTFGWIDTELVEASGEDIHWVDIDNTQGFWMFSSESASVNGKAVAQSGNKAIADTGTTLALVSDEVCQALYDAIPGSKYDEQQQGYVFPTSIKAEDMPEFKVAVGDKEFVIQKEDLAFAPASDGFWYGGVQSRGSNKFDILGDAFLKSIYAIWDQGNTRFGCVPKIEKTQNLQPSSS

SEQ ID NO: 27 - protein, 461 aa, Fusarium oxysporum
MEAIYQVQHQFRLDRGLTRISVKRNPHYQPHGTKSYVHLLNRFGFKPTKPGPYFQDRQIQQRGLAHPRFHAAVGGRVYQTKILRKKLGTDGTLDADGTQIGEVTAEDLPFDSMYLCEVSIGTPPQKFNLDFDTGSADLWVNIPNEALKQRVKNTDQKGHNVFNPLSSSSFNELTDKTWKISYGDGSSASGDCGSDDVTIGGLTIKNQTVELASQLDQQFARGKGDGLLGLAFPQINTVKTNWDSDPADTPVVNMINQHDIPKEAELFTSAFYSQRDANSPESFYTFGFIDTDLVARSGEEISWTRIDSSDGFWKFPSARFSVKGKIIDLSGNKAIADTGTTLVLVSDEVCEALYDAIPGARYSPTQQGYVFPRSTNVEDLPEFKVAIGDKQFDIQPQDLVFAPADKDNWYGGIQSRGNLPFDIFGDAFLKSVYAIWDQGNKRFGVVPKIEETQNLDPTPIA

SEQ ID NO: 28 - protein, 452 aa, Grosmannia clavigera
MQSIFQVQRQVRADLGLEKVRVILNKNYKANGTKSYVHLLNRYGFQPTKPGPYRHVNRVHQRGLRVTDITKVHKPVGGRVHLEKVLAKHSATGDGNTQAGEVTAEDQQNDSMYLCEVEIGTPSQKLMLDFDTGSSDLWVFSTELSADVQKGHAVFDSSKSTTFKTSSGLTWQIEYGDGSSASGDVGTDVVTVGGLVIKNQSVELAKTLAAQFSQGTGDGLLGLAWPSINTIKSGYSSDPQPTPVANMISEGVVPKEAQLFTSCFYGERDNQESFYTFGYIDEDLVKASGAEIAWTSIDNSQGFWMFPSTSASINGQSITLSNNTAIADTGTTLALVSDEVCEALYKAIPNSKYDEKQQGYLIPKTTTIDQLPTVSITVGDNKFVVQKEDLIFTQADDTHWYGGIQSRGSNTFDILGDVFLKSIYAIWDQGNVRFGAVPKIQKTQTLDPGSST

SEQ ID NO: 29 - protein, 432 aa, Botryotinia fuckeliana
MASLQGLSKIRLIPNKNYKRSGTKSYVYLLNKWGFEPTKPGPYFQMNKATATSASFHKFGHKSQTQRVLAKKTATGENGEVPAEDQQNDSEYLCPVQIGTPAQTLMLDFDTGSSDLWVWSTELPKATTSNATGHTIFDPKKSSTFKAAKSSKWQISYGDSSSASGTVGTDTVSLGGLAIKNQAVELATKLSAQFEQGAGDGLLGLAWGSINTVTPTPVATPVENMISQEDIPSDAELFTVNLGSWRDADEADKGASFYTFGYIDQDVVGSQEIYYTPVDNSQGFWMFDSTSATVNGKTVAQTGNQAIADTGTTLALVSDETCQAIYDAIPGSTYDSEQQGYTFPSNTSADDLPVVTFAVGGKQFAVQKEDLGFADAGNGMVYGGIQSRGSMTFDILGDTFLKGIYAIFDQGNTRFGAVQRTEATQNTAAPPA

SEQ ID NO: 30 - protein, 677 aa, Thielavia terrestris
MEADFQLFSSLRYDPVLLQVPASNLTHAGWNWVTSSPLYMLDYHRDRMLQAAAHWGWQAAVEVLDGDAGLKRLAGFVMDSIGGNQPSPLRVRVSISKKGEMSVISGPVPEMPLANLFPTRLPAPGEDPEEAHSNGRSDGQPSKTPEYEILVDSLGATWTAHSHFKTTKRAVYDGARQRAQISLADKKEVLIVNEADGTVMEGSTTTPYFWREGRWVTPAVNMEDKSEKGAGGQNGTSRRWALEKYVNTTPRPRHQDDRHHRHLHKVKIIHNQNYQRHGTKSYVSVLNRFGFQPTKPGPYFQKFTKPTDEAARGKTGPGVKPGHVWVGLYKKTKDDQVGEVTAEDQQNDAEYLCEVSIGTPPQKVTLDFDTGSADLWVNHKSFAPHKSSTFKLAPNMSWRIQYGDGSSASGSVGLDVLSIGGLTIKNQAIEIATTMSDQFSQGSMDGLLGLAFSKINTVETNGQPDPQPTPVENMITQEDIPEDSELFTSAMYSTRDQGEQSFYTFGWIDQDLVKASGQDISWTNVDTSQGFWMFPSESATVNSKKLSLSGNKAIADTGTTLALVSDEVCEALYSQIQGSYYSEQYQGYIIPKSITADDLPDFSVAVGDKEFVIQKEDLLFALADDNSWYGAVQSRGENPFDILGDAFLKSIYAIWDQGNSRFGAVPKIEKTQNIKPE

SEQ ID NO: 31 - protein, 433 aa, Sclerotinia sclerotiorum
MATLQGLSRVRLVPNKNYKRSGIKSYVYLLNKWGFEPTLPGPYFQMNKATEREATYHKFGHKSHHHKRHLAKKTPTGENGEVPAQDQQNDSEYLCPVQIGTPAQTLMLDFDTGSSDLWVWSTELPKSTTSKATGHTIFDPTKSSTFKASKSSKWQISYGDSSSASGTVGTDTVTIGGLAIKNQAVELATKLSAQFEDGAGDGLLGLAWGSINTVTPEPVATPVMNMITQEDIPKDAELFTVNLGSWRDAEDPDKGESFYTFGYIDKDIVGSQEISYTPIDNSQGFWMFDSTSATVNGKTITQDKNQAIADTGTTLALVSDETCQAIYDAIPGSTYDQTQQGYTFPSSTSADDLPVVTFAVGGKQFAVQKEDLGFADAGNGMVYGGIQSRGSMTFDILGDTFLKGIYAIFDQGNVRFGAVQRNEPTQNTSAPPS

SEQ ID NO: 32 - protein, 722 aa, Chaetomium globosum
MDNDFQLFTSLRYDPALLQVSVRKLSYGGWNSVNSSPLYMLDYHRDRMLRAATHWGWNAAVDVLQGDSGLKRLVELVESSIREDQQSPLRVRIAITKDGELSITSGPVPETTLANLFPENLPPPERAGHDGEGRDIPSKSPGYEILVDTPITTRSEHTHFKTTKRAAYDGARQRAQISLFDLKEVLIVNETNGAVMEGSTTTPYFWRDGRWVTPAVSKEYNLEDGSGGQSGTSRRWALERFVNIIFSGRLERPFPRMDDALFQTHADLRKRLALHKIKAIPNSNYKRHGTKSYVSVLNRFGFQPTQPGPYYQKFIKSDDIPPKAAPGVRPGRIWAGLFKKVEGKKEGGEVTAEDQQNDAEYLCEVTIGTGVGSDIQKVMLDFDTGSADLWVSHKKFDHTKSSSFQLAKDKTWKIQYGDGSSASGTVGTDVLVLGGIIIKKQAIEIANEMSAQFSEGTMDGLLGLAFSKINTVQSGGKPDPQLTPVDNMIAQEDIPKEAELFTSAIYSNRDEDRRSFYTFGWIDEDLVKASGEEIAWTNIDKSEGFWMFSSEHASVNGERITIEGNKAIADTGTTLALVTDKVCAALYSKIPGAEYNAEYQGWTIPQSIPVDELPDFSVAVGGKEFVIQKEDLIFVPADKKFFYGGVQSRGENPFDILGNTFLKSIYAIWDQGNSRFGAVRKIEPFQHPIKYNLQPLSSDERTKLGIKKGYGDINTIPFTESA

SEQ ID NO: 33 - protein, 481 aa, Neurospora tetrasperma
MGSMYQVQSKLRQDLGLHKVQAVRKPGRELNGTKAYVSAMARYGFNPTEESRFFHLKKTDLTKEFQRRGYTRHWEQLVRTPQERPDDPQTDNEPIPAEDQQYDTQYLCEIGIGTPQQKVKLDFDTGSADLWVRCTDSSLLHHADKKFDPKKSDTFQESKTDQTWKIQYGDGSTASGTVGTDVITVGGLQIKNQAIELAKKVSSAFSSGEADGLLGLAFSTINTIESDGKPDPQPTPVENMISQDDIPKEAELFTSAFYSARDDKSEEKSFYTFGWVDEDLVKASGKDITWTPIDNSEGFWKFPSESATVDGENVSVSGNAAIADTGTTLALVSDTVCKALYAKIPGSKYSYRYQGYLIPSTITADQLPQLSVAVGGEQFVIQKEDLLLAPADDDHWYGGVQSRGTMPFDILGDTFLKSIYAIWDQGNNRFGAVPKIEVNQHTVFPNTESSPEANSPEPADKIGDVSPVEQVKGAVKSLKLL

SEQ ID NO: 34 - protein, 481 aa, Neurospora crassa
MGSMYQVQSKLRQDLGLHKVQAVRKPGRELNGTKAYVSAMARYGFNPTEESRFFHLKKTDLTKEFQRRGYIRHWEQLVRTPQERPDDPHTDNEPVPAEDQQYDTQYLCEIGIGTPQQKVKLDFDTGSADLWVRCTDSSLLHHADKKFDPKKSDTFQESKTDQTWKIQYGDGSTASGTVGTDVITVGGLQIKNQAIELAKKVSSAFSSGEADGLLGLAFSTINTIESDGKPDPQPTPVENMISQEDIPKEAELFTSAFYSARDDKSEEKSFYTFGWVDEDLVKASGKDITWTPIDNSEGFWKFPSESATVDGDNVSVSGNTAIADTGTTLALVSDTVCKALYAKIPGSKYSYRYQGYLIPSTITADQLPQLSVAVGGEQFVIQNEDLLLAPADDDHWYGGVQSRGTMPFDILGDTFLKSIYAIWDQGNNRFGAVPKIEVNQHTVFPDTEPSPEASSPEPADKVGDVSPVEQVKGAVKSLKVL

SEQ ID NO: 35 - protein, 459 aa, Neosartorya fischeri
MSSCRFSNTLKTAAASLCNYLHTTTTITMATKIKLLPNPQYRKSGTKSYVHLMRKYRFTPTKGGRYFLSSSLHQTGRQYTNLPVGGRARIQHVLRKRIADTDETSEVGADDVQNDTMYLAPVSIGTPAQTVNLEFDTGSTDLWVWSTNLPSATISQHKTGTIFDPSKSSTFKEQSGSTWKISYDDGSFASGTVGTDTISLGGLKVENQAIKLADTLSAQFEQGTCDGLLGLAFSNINTVKPQAVRTPVENMIAQEDIPKSAKLFTAKLGTWKDANEPDEGEPFYTFGFIDQDTVTASGEEVYYTPIDNSQGFWLFDSASATVNGKTIARSGNKAIADTGTTLALVDDETCQAIYDAIPGAHYDDESQGYIFPSNTTEDKLPVVSFAVGDKQFVVQREDLGFAEAKSGYVYGGIQSRGSMTMDILGDTFLKGIYAIFDVGNLRFGAVQRKELHQNLSVPQ

SEQ ID NO: 36 - protein, 431 aa, Penicillium marneffei
MTSKVRVLLNPKYKRNGTKSYVHLLRKYGFDTTLDGPYFHVSHVHQQGKFTTAGQKTVGGRVRIHRTLQKKVNGQAGDVPADDVQNDTMYLAQVGIGTPAQTLKLDFDSGSADLWVWSTELPSSTQSSGSGHTIFDPSKSSSWNSSSGQKWQISYGDGSSASGDVGTDTLNLGGIEVKNQAIEIAKNLSSQFQQSEGDGLLGLAWGSINTVQPQAVQTPMQNLISQNLLPSNAQLFTAHLGEATAKTDNTFYTFGYIDQDTLNATGNQIAYADVDNNQGFWTFQSTSATVNGKTINRSANTAIADTGTTLALIDDNTLKTIYDAIPGSKYDSTQQGYIFPSNTPTDKLPTVTFAVGGSQIAVHKSALGFADAGNGYVYGGIQSRGTNPFDILGDTWLKGLYAVFDVGNTRFGAAAKADPDASSSSSSSSSS

SEQ ID NO: 37 - protein, 395 aa, Trichoderma reesei
MKSALLAAAALVGSAQAGIHKMKLQKVSLEQQLEGSSIEAHVQQLGQKYMGVRPTSRAEVMFNDKPPKVQGGHPVPVTNFMNAQYFSEITIGTPPQSFKVVLDTGSSNLWVPSQSCNSIACFLHSTYDSSSSSTYKPNGSDFEIHYGSGSLTGFISNDVVTIGDLKIKGQDFAEATSEPGLAFAFGRFDGILGLGYDTISVNGIVPPFYQMVNQKLIDEPVFAFYLGSSDEGSEAVFGGVDDAHYEGKIEYIPLRRKAYWEVDLDSIAFGDEVAELENTGAILDTGTSLNVLPSGLAELLNAEIGAKKGFGGQYTVDCSKRDSLPDITFSLAGSKYSLPASDYIIEMSGNCISSFQGMDFPEPVGPLVILGDAFLRRYYSVYDLGRDAVGLAKAK

SEQ ID NO: 38 - protein, 395 aa, Trichoderma virens
MKSALIAAAALVGSAQAGVHKMKLQKVSLEQQLEGSTIESQVQHLGQKYMGVRPTSRADVMFNDKLPKIQGGHPVPVTNFMNAQYFSEITIGTPPQTFKVVLDTGSSNLWVPSQSCNSIACFLHATYDSSSSSTYKQNGSDFEIHYGSGSLTGFISNDVVTIGDLKIQKQDFAEATSEPGLAFAFGRFDGILGLGYDTISVNGIIPPFYQMVNQKLLDEPVFAFYLGSGDEGSEAVFGGVDESHYSGKIEYIPLRRKAYWEVDLDSIAFGDEVAELENTGAILDTGTSLNVLPSGLAELLNAEIGAKKGFGGQYTVDCSKRDSLPDITFSLAGSKYSLPATDYIIEMSGNCISSFQGMDFPEPVGPLVILGDAFLRRYYSVYDLGKNAVGLAKAK

SEQ ID NO: 39 - protein, 395 aa, Trichoderma atroviride
MKSALIAAAALVGSAQAGVHKMKLQKVSLEQQLEGSSIEAQVQQLGQKYMGVRPTSRVDVMFNDNVPKVKGGHPVPVTNFMNAQYFSEITIGSPPQTFKVVLDTGSSNLWVPSQSCNSIACFLHSTYDSSSSSSYKKNGSDFEIHYGSGSLTGFISNDVVTIGDLQIKGQDFAEATSEPGLAFAFGRFDGILGLGYDTISVNGIVPPFYQMVNQKLLDEPVFAFYLGSGDEGSVATFGGVDESHYSGKIEYIPLRRKAYWEVDLDSIAFGDEVAELENTGAILDTGTSLNVLPSGIAELLNAEIGAKKGYGGQYTIDCAKRDSLPDITFSLAGSKYSLPASDYILEVSGSCISTFQGMDFPEPVGPLVILGDAFLRRYYSVYDLGKGAVGLAKAK

SEQ ID NO: 40 - protein, 395 aa, Trichoderma aureoviride
MKSALIAAAALVGSAQAGVHKMKLQKVSLEQQLEGSSIEAQVQQLGQKYMGVRPTSRADVMFNDNLPKIKGGHPVPVTNFMNAQYFSEITIGSPPQTFKVVLDTGSSNLWVPSQSCNSIACFLHSTYDSSSSSTYKKNGSDFEIHYGSGSLTGFISNDVVTIGDLKIKGQDFAEATSEPGLAFAFGRFDGILGLGYDTISVNGIVPPFYQMVNQKLLDEPVFAFYLGNSDEGSVATFGGVDESHFSGKIEYIPLRRKAYWEVDLDSIAFGDEVAELENTGAILDTGTSLNVLPSGIAELLNAEIGAKKGYGGQYTIDCAKRDSLPDITFSLAGSKYSLPASDYILEVSGSCISTFQGMDFPEPVGPLVILGDAFLRRYYSVYDLGKGAVGLAKAK

SEQ ID NO: 41 - protein, 398 aa, Aspergillus niger
MKSASLLTASVLLGCASAEVHKLKLNKVPLEEQLYTHNIDAHVRALGQKYMGIRPSIHKELVEENPINDMSRHDVLVDNFLNAQYFSEIELGTPPQKFKVVLDTGSSNLWVPSSECSSIACYLHNKYDSSASSTYHKNGSEFAIKYGSGSLSGFISQDTLKIGDLKVKGQDFAEATNEPGLAFAFGRFDGILGLGYDTISVNKIVPPFYNMLDQGLLDEPVFAFYLGDTNKEGDESVATFGGVDKDHYTGELIKIPLRRKAYWEVELDAIALGDDVAEMENTGVILDTGTSLIALPADLAEMINAQIGAKKGWTGQYTVDCDKRSSLPDVTFTLAGHNFTISSYDYTLEVQGSCVSAFMGMDFPEPVGPLAILGDAFLRKWYSVYDLGNSAVGLAKAK

SEQ ID NO: 42 - protein, 398 aa, Aspergillus fumigatus
MKSTSLLTASVLLGSASAAVHKLKLNKVPLDEQLYTHNIDAHVRALGQKYMGIRPNVHQELLEENSLNDMSRHDVLVDNFLNAQYFSEISLGTPPQKFKVVLDTGSSNLWVPGSDCSSIACFLHNKYDSSASSTYKANGTEFAIKYGSGELSGFVSQDTLQIGDLKVVKQDFAEATNEPGLAFAFGRFDGILGLGYDTISVNKIVPPFYNMLDQGLLDEPVFAFYLGDTNKEGDNSEASFGGVDKNHYTGELTKIPLRRKAYWEVDFDAIALGDNVAELENTGIILDTGTSLIALPSTLADLLNKEIGAKKGFTGQYSIECDKRDSLPDLTFTLAGHNFTIGPYDYTLEVQGSCISSFMGMDFPEPVGPLAILGDAFLRKWYSVYDLGNNAVGLAKAK

SEQ ID NO: 43 - protein, 398 aa, Aspergillus clavatus
MKTVSLLTASALLGCASAEVHKLKLNKVPLEEQLYTHNIDAHVRALGQKYMGIRPNIHKELLEENSFNDMSRHDVLVDNFLNAQYFSEIELGTPPQKFKVVLDTGSSNLWVPSSECGSIACYLHTKYDSSASSTYKKNGTEFAIRYGSGELSGFVSQDNLKIGDLKIEKQDFAEATNEPGLAFAFGRFDGILGLGYDTISVNKIVPPFYNMLNQGLLDEPVFAFYLGDANKEGDSSVATFGGIDKDHFTGELTKIPLRRKAYWEVDLDAIALGDNVAELDNTGVILDTGTSLIALPSTLADLLNKEIGAKKGFTGQYSVECDKRDSLPDLTFTLSGHNFTIGPYDYTLEVQGSCISSFMGMDFPEPVGPLAILGDAFLRKYYSVYDLGNHAVGLAKAK

SEQ ID NO: 44 - protein, 396 aa, Nectria haematococca
MKSALLAAAALLGSAQAGVHKMKIQKVPLAEQLATTSIETHIQNLGQKYLGSARPKNQADYAFSTEAINVEGGHPVPISNFMNAQYFSEITIGNPPQSFKVVLDTGSSNLWVPSQECGSIACYLHSKYDSSASSTYKQNGSEFEIHYGSGSLSGFISNDDVSIGDLKIKGQDFAEATKEPGLAFAFGRFDGILGLGYDTISVNHIVPPFYQMVNQKLLDDPVFAFYLADQEGESEVVFGGVDKSHYEGDIEYIPLRRKAYWEVDLDAIALGDEVAEQENTGAILDTGTSLNVLPSALAELLNKEIGAKKGYNGQYTVECDKRQTLPDITFTLAGSNYSLPATDYILEVSGSCISTFQGMDFPEPVGPLVILGDAFLRRYYSVYDLGKNAVGLARSK

SEQ ID NO: 45 - protein, 399 aa, Glomerella graminicola
MKSTLLTAAVLLGAAQAEVHKLKLKKVPLEEQLNAVPIEHQVRQLGQKYMGTRPNNHADAMFNQKPIQTDGEHPVPVSNFMNAQYFSEIQIGTPPQTFKVVLDTGSSNLWVPSQQCGSIACYLHTKYDSSASSTYKSNGSSFEIHYGSGSLTGFVSQDDVSIGDLKIKKQDFAEATSEPGLAFAFGRFDGILGLGYDTISVNKIVPPFYNLVNQKAIDEPVFAFYLGDTNEEGDESEATFGGLDESHYEGKVTYIPLRRKAYWEVDLDAISLGDETADLEGHGAILDTGTSLNVLPSALAELLNKEIGAKKGYNGQYSVECSKRDELPDITFTLAGYNFSISAYDYVLEVSGSCISTFQGMDFPEPVGPLVILGDAFLRRWYSVYDLGKNAVGLAKAKK

SEQ ID NO: 46 - protein, 395 aa, Cordyceps militaris
MKSALIAAAVLAGSAHAGIHKMKLQKIPLAEQLVGASFEAQAQQLGQKYLGARPASRADIIFNAKVAESKNGHLVPVSNFANAQYFSEITIGTPPQTFKVVLDTGSSNLWVPSQSCSSIACFLHSTYDSSSSSTYKKNGSDFEIHYGSGSLTGYVSNDVVRIGDLTIKNTDFAEATNEPGLAFAFGRFDGILGLGYDTISVNHMVPPFYQMIKQKLLDEPVFAFYLGSEEEGSEAVFGGVDKNHYEGKIEYLPLRRKAYWEVDFDAIAFGKEVAELENTGVILDTGTSLNTLPSDLAELLNKEIGAKKGFGGQYTIDCAARDKLPDITFTLAGSNYTLPATDYILELGGSCVSTFTPLDMPPPAGPLAILGDAFLRRYYSVYDLNKNAVGLARAK

SEQ ID NO: 47 - protein, 396 aa, Gibberella zeae
MKSALLTAAALLGSAQAGVHKMKLNKVPLADQLAMNSVEDHLQSLGQKYMGAARPKNAADYAFATNVPSVEGGHPVPVSNFMNAQYFSEITIGTPPQSFKVVLDTGSSNLWVPSQECGSIACYLHSKYDSSASSTYKKNGSEFEIHYGSGSLSGFVSNDVVSIGDLKIKDQDFAEATKEPGLAFAFGRFDGILGLGYDRIAVNGMVPPFYQMVNQKLLDEPVFAFYLDGQEGQSEATFGGVDKSKYTGDLEYIPLRRKAYWEVDLDAIAFGDEVAEQENTGAILDTGTSLNVLPSALAELLNKEIGAKKGYNGQYTIECDKVSSLPDITFTLAGSNYSLPSTDYILEVQGSCISTFQGMDFPEPVGPLVILGDAFLRRYYSVYDLGKNAVGLARAK

SEQ ID NO: 48 - protein, 395 aa, Metarhizium anisopliae
MKSALIAAAALAGTAHAGVHKMKLQKISLEEQLAGASIEQHVRALGQKYLGARPASRASVMFNTKAPQVAEGHPVPVSNFMNAQYFSEITVGTPPQTFKVVLDTGSSNLWVPSQSCSSIACYLHSTYDSSSSSTYKKNGSSFEIRYGSGSLSGFVSQDVVTIGDLKIKDQDFAEATSEPGLAFAFGKFDGILGLGYDTLSVNKIVPPFYQMINQKLLDEPVFAFYLGSSEEGSEAVFGGIDKDHYTGKIEYIPLRRKAYWEVDIHSIAFGDDVAELDRTGAILDTGTSLNVLPSTLAELLNKEIGAKKSWNGQYTVDCAQIKSLPDIVFNLAGSNYSLPASDYILELQGTCISTFQGMDIPEPAGPLIILGDAFLRRYYSIYDLGRNAVGLARSK

SEQ ID NO: 49 - protein, 396 aa, Fusarium oxysporum
MKGALLTAAALLGSAQAGVHKMKLNKVPLADQLATNSVEDHLQSLGQKYLGASRPKNAADYAFATNTVNVEGGHPVPVSNFMNAQYFSEITIGTPPQSFKVVLDTGSSNLWVPSQQCGSIACYLHSKYDSSASSTYKENGTEFEIHYGSGSLSGFVSNDVVSIGDLEIKDQDFAEATKEPGLAFAFGRFDGILGLGYDRIAVNGMVPPFYQMVNQKLLDEPVFAFYLDDQEGESEATFGGIDKSKFTGDIEYIPLRRKAYWEVDLEAIAFGDEVAEQENTGAILDTGTSLNVLPSALAELLNKEIGAKKGYNGQYTIECDKRASLPDITFNLAGSNYSLPATDYILEVQGSCISTFQGMDFPEPVGPLVILGDAFLRRYYSVYDLGKNAVGLARAK

SEQ ID NO: 50 - protein, 395 aa, Metarhizium acridum
MKSALIAAAALAGTAHAGVHKMKLQKISLKEQLADAPIEQHVQALGQKYIGARPPSRASVMFNTKAPQVAGGHPVPVSNFMNAQYFSEITIGSPPQSFKVVLDTGSSNLWVPSQSCNSIACYLHSTYDSSSSSTYKKNGSSFEIRYGSGSLSGFVSQDVVSIGDLKIEHQDFAEATSEPGLAFAFGKFDGILGLGYDTLSVNKIVPPFYQMIDQKLLDEPVFAFYLGSKEEGSEAVFGGIDKNHYTGELEYLPLRRKAYWEVDINSIALGDEIAELDHTGAILDTGTSLNVLPSTLAELLNKEIGAKKSWNGQYTVDCDKIKSLPDIVFNLSNSNYSLPASDYILELQGTCLSTFQGMDIPEPAGPLVILGDAFLRRYYSVYDLERNAVGLARAK

SEQ ID NO: 51 - protein, 398 aa, Verticillium dahliae
MKSTLIAAALLGSASAEIHKLKLKKVPIEEQLTSVPIETQVQQLGQKYMGVRPQSHADYMFNSKPVQSDGNHNVPVSNFMNAQYFSEITIGTPPQTFKVVLDTGSSNLWVPSQQCSSIACYLHTKYDSSDSSTYKANGSEFEIHYGSGSLTGFVSQDTVTIGDIKIKNQDFAEATSEPGLAFAFGRFDGILGLGYDTISVNKIVPPFYQMVNQKAVDEPVFAFYLGDTNEQGDESEVVFGGVDESHYEGKITTIPLRRKAYWEVDLDSISLGDNTAELDGHGAILDTGTSLNVLPSTLADMLNNEIGAKKGYNGQWSVECDKRASLPDITFNLAGYNFSISAYDYILEVSGSCISTFQGMDFPEPVGPLVILGDAFLRRWYSIYDLGKNTVGLAKAKK

SEQ ID NO: 52 - protein, 398 aa, Botryotinia fuckeliana
MKGAFLAAASLLGSVSAGVHKMPLKKVSLSEQLATANMQEHAKHLGQKYMGVRPESHASEMFKETSVHDAGDHTVPVSNFLNAQYFSEITIGTPPQSFKVVLDTGSSNLWVPSSQCGSIACYLHTKYDSSSSSTYKQNGTSFEIRYGSGSLSGFTSKDVMTIGDLKIKDQVFAEATEEPGLAFAFGRFDGILGLGYDTISVNSIVPPFYSMVDQGLLDEPVFAFYLGSNDESDPSEAIFGGVNKDHYDGKITEIPLRRKAYWEVDLDSIAFGDSEAELENTGVILDTGTSLIALPADLAGLLNAEIGAKKGWNGQYTVDCAKRDSLPELTFTLSGHKFPIGPYDYILEVQGSCISAIMGMDFPEPVGPLAILGDAFLRRYYSIYDLGKNTVGLAKAKA

SEQ ID NO: 53 - protein, 396 aa, Chaetomium globosum
MKGALLTAAVLLGSAQGAVHKMKLQKVPLSEQLEAVPLNTQLEQLGQKYMGVRPRQSHANAVFNGMVAEVKGNHPVPISNFMNAQYFSEITIGSPPQTFKVVLDTGSSNLWVPSVECGSIACYLHTKYDSSASSTYKKNGTNFEIRYGSGSLSGFVSQDTMTIGDITIKGQDFAEATSEPGLAFAFGRFDGILGLGYDTISVNGIVPPFYKMLEQKLIDEPVFAFYLADEKGQSEVVFGGVDSDKYKGKITTIPLRRKAYWEVDFDAISYGDDTAELENTGVILDTGTSLIALPSQLAEMLNAQIGAKKNYAGQYAIDCNKRDSLKDVTFNLAGYNFTLGPYDYILEVSGSCISTFMGMDFPEPTGPLAILGDAFLRRYYSIYDLGANTVGLAEAK

SEQ ID NO: 54 - protein, 396 aa, Thielavia terrestris
MKGALLTAAVLLGSAQGAVHKLKLQKIPLAEQLESVPIQTQLEHLGQKYMGLRPKQSHASAVFNGMPVEVEGNHPVPISNYMNAQYFSEITLGTPPQSFKVVLDTGSSNLWVPSVECGSIACYLHSKYDSSASSTYKKNGTSFDIRYGSGSLSGFVSQDTLSIGDITVKGQDFAEATSEPGLAFAFGRFDGILGLGYDTISVNGIVPPFYKMVEQKLVDEPVFAFYLADTNGESEVVFGGVDKDRYKGKITTIPLRRKAYWEVDFESLSYGDDTADFENTGAILDTGTSLITLPSQLAEMLNAQLGAKKNFAGQYVLDCSKRDSLEDITFNLAGYNFTLGPQDYILEISGSCMSTFTPMDFPAPTGPLAILGDAFLRRYYSIYDLGANTVGLAEAN

SEQ ID NO: 55 - protein, 395 aa, Magnaporthe oryzae
MKGAMMTAAVLLGTAEAGVHKLKMKKIPLEDQLKTFDLNAQMRGLGQKYLGIRPESHQQAVFSNDAVQASGNHPVPISNFMNAQYFSEITIGTPPQNFKVILDTGSSNLWVPSSSCGSIACYLHNKYESSSSSTYKKNGTEFKIQYGSGSMEGFVSNDVMTIGDLKIKNLDFAEATKEPGLAFAFGRFDGILGMGFDRLSVNKIVPPFYAMVDQKLIDEPVFAFYLADEKSESEVVFGGVNKDHIDGKITEIPLRRKAYWEVDLDAIALGDEVAELDNTGVILDTGTSLIALPSQLAELLNSQIGAKKGYNGQYSIDCDKRKDLPDITFRLSGYDFPISAYDYILEVSGSCISTFMAMDIPEPVGPLAILGDAFLRRYYSIYDLGKGTVGLAKAK

SEQ ID NO: 56 - protein, 396 aa, Tuber melanosporum
MKSSIIFAAGSLLGSAMAGVHRAPLKKVPLTEQLSHHDINTQMRALGQKYMGIRPEKIDEEMFKTQEIKTDDGHPVPVSNFLNAQYFSEITIGTPPQTFKVVLDTGSSNLWVPSSQCGSIACYLHSKYDSSTSSTYRPNGTSFEIRYGSGSLSGFVSQDNIEIGNLKIKDQTFAEATSEPGLAFAFGRFDGILGLGYDSISVNHIVPPFYQMVDQGLLDEPVFAFYLGDKDDQSEAIFGGIDKAHYQGKLIKLPVRRKAYWEVEFEAITFGKSTAQFENTGAIVDTGTSLIALPSTLAELLNKEIGAKKGFNGQYSVECEKRDSLPDLTFTLTGHDFTITAYDYILEVQGSCISAFMGMDFPEPIGPLAILGDAFLRRYYSVYNLGDNTIGLAKSK

SEQ ID NO: 57 - protein, 396 aa, Neurospora crassa
MKGALLTAAMLLGSAQAGVHTMKLKKVPLAEQLESVPIDVQVQHLGQKYTGLRTESHTQAMFKATDAQVSGNHPVPITNFMNAQYFSEITIGTPPQTFKVVLDTGSSNLWVPSSQCGSIACYLHNKYESSESSTYKKNGTSFKIEYGSGSLSGFVSQDRMTIGDITINDQLFAEATSEPGLAFAFGRFDGILGLGYDRIAVNGITPPFYKMVEQKLVDEPVFSFYLADQDGESEVVFGGVNKDRYTGKITTIPLRRKAYWEVDFDAIGYGKDFAELEGHGVILDTGTSLIALPSQLAEMLNAQIGAKKSWNGQFTIDCGKKSSLEDVTFTLAGYNFTLGPEDYILEASGSCLSTFMGMDMPAPVGPLAILGDAFLRKYYSIYDLGADTVGIATAKR

SEQ ID NO: 58 - protein, 426 aa, Trichoderma reesei
MKFHAAALTLACLASSASAGVAQPRADEVESAEQGKTFSLEQIPNERYKGNIPAAYISALAKYSPTIPDKIKHAIEINPDLHRKFSKLINAGNMTGTAVASPPPGADAEYVLPVKIGTPPQTLPLNLDTGSSDLWVISTDTYPPQVQGQTRYNVSASTTAQRLIGESWVIRYGDGSSANGIVYKDRVQIGNTFFNQQAVESAVNISNEISDDSFSSGLLGAASSAANTVRPDRQTTYLENIKSQLARPVFTANLKKGKPGNYNFGYINGSEYIGPIQYAAINPSSPLWEVSVSGYRVGSNDTKYVPRVWNAIADTGTTLLLVPNDIVSAYYAQVKGSTFSNDVGMMLVPCAATLPDFAFGLGNYRGVIPGSYINYGRMNKTYCYGGIQSSEDAPFAVLGDIALKAQFVVFDMGNKVVGFANKNTNV

SEQ ID NO: 59 - protein, 417 aa, Trichoderma virens
MKFHAAALTLAYLANSASASVAQPRSEAAQAPEDGKTFSITQIQNERFRGPNVPASYIAALAKYSPQVSEHIKHAIRLVEETGNQTGTAVATPAPGADSEYVLPVKIGTPPQTVPLNLDTGSSDLWVLSTDTYPSQIQGQAIYDPNASNTSRRQTGLSWLIRYGDGSSANGIVYKDRVQIGNTFFDQQAIESAIRVSDDISDDTFASGLLGAAGSAGNTVRPDKQKTYLDNIKDQLAKPLFTANLKKGKPGNYNFGYINASEYTGDIQYAAINPKGPLWEISVSGYRVGSDESKYVSRVWNAIADTGTTLLLTPTDIVNAYYAQVNGSTMNDDVGMMVVPCTAKLPDFVFGLGKYRGVIPGTYMNYGRMNRTYCYGGLQDSEGAPFAVLGDIALKAQFVVFDFGNNVVGFANKNTTV

SEQ ID NO: 60 - protein, 543 aa, Trichoderma atroviride
MEYALNASTAIHAEYHSSVAVVRGLHARVCLSNVSVVPSMITMKEMKMCLRKFVVSPVELQHFPQAIELEQSFPHAHALGSIPGQVFGRIITGVGQDIDMSEGGLQHSFHQIATALNLIMKFHATSLAIACLASSASAAVAQPKGTAETTPQGEEFSITQIRNERWKGPNAPAAYIAALAKYSPTIPDSIKHAIRVNPGLRQKFGKLINAGNQTGTGVATPSPGGDAEYVLPVQIGTPPQTLPLNLDTGSSDLWVLSTDTYPSQVEGQPLYKPNNSTTSKRLPGESWVIQYGDGSSANGIVYTDRVQIGNTFFNTQAIESAINVSDEISDDTFSSGLLGAAFSTANTVRPDQQKTYLDNIKDQLVKPVFTANLKKGKPGNYNFGYINASEYTGNIQYAAIKPRSPLWEISVSGYRVGSNDTNYVARVWNAIADTGTSLLLAPVDIVNAYYKQIAGSKLDSGYGMMVFPCNTTLPDFVFGLGTYRGVIPGSYINYGKINRTYCFGGIQSSEDAPFAVLGDILLKAQFAVFDMGNKVVGFANKPV

SEQ ID NO: 61 - protein, 446 aa, Metarhizium acridum
MKATIAAIVLALLAEGAVVGERVDAAPQAPAPRTNGRSFTLHQVVNNNFQGHDGPTSFLRAHFKYAQKLPDYLSKLVEINPNFRIKFGAASQGKCYPEVTLWQVLSLLLTSIIAGEQVGTVEANPSPLVDTEYAVEIGIGTPPQRIRLNLDTGSSDFWVFSTDTTPSMVHDQGLYNANKSTTSHFLTGESWKIKYGDNASASGYVYTDRVQIGETYVDTQAVQVAVNVTEDLSEDKFVSGILGMANSAANTVRPTPQRTYIDNIKNDLALPLFTANLQRQAPGSYNFGYIDDFEYTGDISYTPIERTFPLWMVHTTGYRIGKTSHDKSINAIVDTGTSLLLLPETVVSNYYAKVKGSSVDPRLGMRVVPCNANLPDFYLTIGSYRGRVPGSYMNYGRVSGNSCFGGIQSSDALPFSVLGDVFLKTQFVVFDYGNARVGFARKNLYE

SEQ ID NO: 62 - protein, 560 aa, Fusarium oxysporum
MKFSTVSFLLLAGCSTGIPHEIRGDVYEVKNPFSPNAVDPEVEGVKGLQKRTIDPKGDQALVARGDVYEVKNPFSPNAVDPEVEGVKGLQDRDIKPRDVSNNDPLEARGDIYEVKNPFSPNAVDPEVEGVKGLQERDIDPEEQEEEELGKTLRGRAIDHENDPDSAHLKPRAGGEKVKMDQLTNTRYKKPHAEIALIQAYNKYHKPLPPKLKKIAQHEADLIKNKLGMKGTASATPPQYYDSQYVVPVKIGTPAQQTYLNFDTGSSDLWVFSTDTYQPDQAGHILYKPDKSTTSKRLNGQTWSIRYGDGTGASGIVYTDKVQVGKTYVNKQAVESATEVSDGIASDKFSHGIMGLAMSSLNTVRPTPQNTYFQNVQNNLAVPVFTANLQKGKAGNYNFGYIDQGEYYGSIQFAKVKKGSPWWQINIEGYRIAAGAPWHKYNYSAIVDTGTTLLLLPGVLTNFYYRKVKGAYIDQDYGVWVFPCTSKLPSFYFGFGSYQGKVPGNYINYGRLTNTVCYGGIQSSDGIGFAILGDILLKAQFVVFDLKGQRVGFANKLTIKS

SEQ ID NO: 63 - protein, 432 aa, Cordyceps militaris
MKTTTLTAALALATTGYSAAQWSPVSSAATGANARFSLQQMYNDKFKGVNPTDALLRAYSRYATFVPDHIQALVDKEPSLKATFHALFSGTETHALKTVHAEAAPPSDVDSEYVLPVSLGTPPQILPLNLDTGSSDFWVFSTATPQDELRGQKIYYPQNSTTSKTLPGEHWKIRYGDNSTANGDVYIDRAAIGPVGFDKQAIQVATAISSSIAEDGFFSGILGMASSYANTVKPTKQVTFLDNIKDTLDAPVFTANLQKGMSGNYNFGYIDASEHTGDIAYTPINTNSSFWEVELSGYQFGQDAFKNERVVGIVDTGTTLLLFPQHVVDEYYGKLPGSFFDKQSATMVFPCDLTPPDFFFGVGNDYRGRIPGHYMNYAHQSAKYCYGGLQSAKGIPFCIFGDILLKAQFVVFDRGNLSVGFANKKTVPAPQS

SEQ ID NO: 64 - protein, 480 aa, Gibberella zeae
MRFSTVSFLLLAGCSTGIPHEIRGGHEVNGASVDHPEKPLGRAERRSTDLQVDGSRALTVRSDAYEDPIDGTEEEDIDLEELEEIEMGKGLKGRAIDPETDPDSAHLKPHAEIALIHAYNKYRKPLPNQELKKIAAQEEAFVKNKLGMKGTAAATPPQYYDSQYVVPVQIGSPQQTTYLNFDTGSSDLWVFSTDTYQPDQAGHILYKPDKSTKCKRLNGQTWSIKYGDGTGASGIVYLDTVRVGKTYVNQMAVQSATEVSDGIASDTFAHGILGLAMSSLNTVRPTAQKTYFERVQGALEVPIFTANLKKGSAGNYNFGYLDQSEYYGSVGFAAVKKDSPWWQITVEGFRVAQGAPWHKYKYSAIVDTGTTLLLLPDYLVKFYYKKVKGAYIDNDYGVWVFPCTAKLPSFYFGFGNYRGKVPGHYINYGRLTSTVCYGGIQTSEGIGFAILGDILLKAQFVIFDLKGNRVGFANKNTVKA

SEQ ID NO: 65 - protein, 432 aa, Verticillium dahliae
MHYLTYLNCLAAVAAASPLAVAEPANIDGSTFTLRQVENKDFAGQTGLDELVWAYIKYNAELPAKVREAIVIGKHVNARFKGLVQRGTTDDKSASFGTVQAFPPRNVDIQYVVPVQIGSPPQTVFLNLDTGSGDLWTFSSETPEWQRGDHRIYSPELSNTSVLQDGLTWRITYGDGSGASGNVYNDRVALGKTSFAAQAIESASQVSPSFTRDSFASGILGLGFGRGNTVKPRPVKTYFENVMPALASPVFTSNLQAGRPGNYNFGFVARNEYTGRIGYTPVTKRNPYWEIKVDGTQIGGGEYNRTTTLDRVIVDTGTTLLMLPDEHVDAYYDQVEGARFSPSWAAYLFPCDATLPDWTFGLGDYRGKLPGRYVRYNQVNETHCFGGIQSSAGIPFAIFGAALLKAQFAVFDYVEADREVQPRVGFANKPLR

SEQ ID NO: 66 - protein, 259 aa, Trichoderma reesei
MAPASQVVSALMLPALALGAAIQPRGADIVGGTAASLGEFPYIVSLQNPNQGGHFCGGVLVNANTVVTAAHCSVVYPASQIRVRAGTLTWNSGGTLVGVSQIIVNPSYNDRTTDFDVAVWHLSSPIRESSTIGYATLPAQGSDPVAGSTVTTAGWGTTSENSNSIPSRLNKVSVPVVARSTCQADYRSQGLSVTNNMFCAGLTQGGKDSCSGDSGGPIVDANGVLQGVVSWGIGCAEAGFPGVYTRIGNFVNYINQNLA

SEQ ID NO: 67 - protein, 255 aa, Trichoderma atroviride
MAPASAVVSALMLPALALGAAIEPRGAEIVGGTTAAAGEFPYIVSLSSGGSHFCGGVLANANTVITAGHCSVDFSASQVKVRAGSLTWASGGTQVGVSSITVNPSYTTKNGVPDFDVAVWKLSTPIQTSSTIGYVTLPASGSDPAAGTTLTTAGWGTTSENSNSLPSRLNKVSVPVISRASCNSEYGNIISNNMFCAGLSQGGKDSCSGDSGGPIVDSNGVLQGLVSWGQGCAEAGFAGVYVRLGNLLSFVNSHL

SEQ ID NO: 68 - protein, 254 aa, Trichoderma virens
MAPVSQVVSALMLPALALGAAIEPRGADIVGGTAAALGEFPYIVSLSTQGSHFCGGVLVNANTVVTAAHCSVDFTASQVKVRAGTLTWASGGTQVGVSKIIVNPSYNSRTTDFDVAVWKLASSIPQSSTIGYATLPAAGSDPAAGSIVTTAGWGTTSEGSSSLPARLNKVSIPVVSRATCQSEYGRSAITTNMFCAAQAQGGKDSCQGDSGGPIVDANGVLQGLVSWGNGCAEAGFAGVYSRLGALLSFVQANL

SEQ ID NO: 69 - protein, 254 aa, Hypocrea lixii
MAPVSQIVSALMLPALALGAAIEPRGADIVGGTAAALGEFPYIVSLSTQGSHFCGGVLVNANTVITAAHCSVDFSASQVKVRAGTLTWASGGTQVGVSRIIVNPSYNSRTTDFDVAVWKLASSIPESSTIGYATLPAAGSDPAAGSIVTTAGWGTTSEGSSSLPARLNKVSVPVVSRATCQSEYGRSAVTTNMFCAAQAQGGKDSCQGDSGGPIVDANGVLQGLVSWGNGCAEAGFAGVYSRLGSLLSFVQANL

SEQ ID NO: 70 - protein, 258 aa, Hypocrea lixii
MAPVLAIASVLAALPALTMGAAITPRGSDIVGGTTAALGEFPYIVSLSTGGSHFCGGVLIDSRTVVTAGHCTIDQRASSVKVRAGTLTWASGGTQVGVSSLTLHPSYTVDSQGVPDNDVGVWHLATAIPTSSTIGYATLPASGSDPAAGTTLTVAGWGTTSENSNSLPSTLRKVSVPVVARATCDSDYDGEISNNMFCAAVAAGGKDSCSGDSGGPIIDPSGTLVGVVSWGQGCAERGFPGVYTRLGNYVSFINSNRG

SEQ ID NO: 71 - protein, 271 aa, Sclerotinia sclerotiorum
MAPILNFALALAMPILSMAAALPSGTELENRGTTLTGTVGIVGGTTAALGEFPYIVSLTYAGSHFCGGVLLNAYTVLTAAHCSVSYSASSVKVRAGTLTWASGGTQVGVSKVVVHPSYNSRTIDNDIALWHLSTAIPSSSTIGYAKLPVQGSDPVVGSTATVAGWGLLTENSSSLPATLRKVSVPVISRSTCQAEYGTSSVTTNMWCAGVTGGGKDSCSGDSGGPIIDAATGVLEGTVSWGQGCAEAGYAGVYSRVGNYVTYIQSSLWTSL

SEQ ID NO: 72 - protein, 271 aa, Botryotinia fuckeliana
MAPILNFALALAMPILSLAAALPTGAELENRATTLGGTPDIVGGTTAALGEFPYIVSLSYSGSHFCGGVLLNAYTVLTAAHCSVSYSASSVKVRAGTLTWASGGTQVGVSKVVVHPSYSSSTTNNDIALWHLSTALPASSTIGYAKLPVQGSDPVVGSTTTVAGWGLLTENGSTLPSTLRKVSVPVISRASCQAEYGTSAVTTNMWCAGYAAGGKDSCSGDSGGPIIDTATGVLEGTVSWGQGCAEAGYAGVYARVGNYVTYINSNLWTSL

SEQ ID NO: 73 - protein, 263 aa, Phaeosphaeria nodorum
MHAQSILAALAVPALVYGAAIPQEFPENWDETSEDIVGGVTAAQGDVPFIVSVSLSGVGHYCGGSLINANTVVSAAHCYQGETATDFSVRAGSLNKNSGGTTSAVASIVIHPSYNSRTSDNDIAIIKLRTPIATSSTISYASLAASGQDPAAGTTLTVAGWGATTQGGGSPTTLRKVDVPVVARTTCRSRYSTIGLSVTDQMFCAGFTAGGKDSCQGDSGGPIITSSKQLVGIVSWGEGCAQPNFPGVYSRVGSLTSFISANL

SEQ ID NO: 74 - protein, 265 aa, Leptosphaeria maculans
MQIKDLVVALAVPAICIAAAIPTPQDPVETEFPEESQEDIVGGTAAAAGEFPYIVSLQRSGSHFCGGSLLNGNTVVTAAHCAVGLSGTAVTVRAGSNSRTSGGVTARSSSIVINPGYSSSTFDGDVAIIKLSTSIPTSNTISYVSLPAAGSDPAAGSVATVAGWGTLTSGSQSLPVNLQKVDVPIVSRTTCRSNYGQSAITNNMICAGLTQGGKDSCQGDSGGPIVSSSKQLIGLVSWGDGCAAPGKPGVYTRVAAVLSFINANS

SEQ ID NO: 75 - protein, 256 aa, Verticillium dahliae
MVFKTLVAALGFTAVAFGSPVPAPQEELQIVGGVAASAGDFPFIVSLQRSGSHFCGGSLLNANTVLTAAHCSTGVSASSVTVRAGSLNRSSGGTLVRVSSIVVNPGYVASRYDNDFAIWKLATPIPTSSTISYATLAAANSDPAANTLTTTAGWGTTSSGGSTLPTALRKVDVPIISRTTCRSYYGTSAVTTNMICAGFAAGGKDSCQGDSGGPIIEASSRTLVGVVSWGEGCAAPNAPGVYARVGAARTFINQYL

SEQ ID NO: 76 - protein, 261 aa, Cochliobolus carbonum
MRFQSMITAALPALVLSAPTPQWDDVPEDSIVGGTTAAAGEYPFIVSIQLGGRHNCGGTLINGNTVVTAAHCSVSSAIGGSINNVAVRVGSLSANSGGQVIKVSKIIIHPSYQASTSNNDIAIWKLSSTVTAGGNIGFASLAASGSDPASGSTTSVAGWGATREGGGANNALLKVSVPIVARSTCVSNYNAVGLTVTTNMVCAGVTAGGRDSCQGDSGGPLVDANKTLIGVVSWGTGCARPNLPGVYSRVGTLRSFIDQNA

SEQ ID NO: 77 - protein, 257 aa, Metarhizium acridum
MVSRSAIAIASAVFAVQSATAAPAKGGKFIVGGQAANEGEFPFIVTVLLNGTHYCGGTLVNEDTVVTASHCTKSDVSGYEIRAGSLAWASGGTKVKVASAVRHPGYNSTNYDNDVAVWKLATPIPESSTIQYAKLPAQGSDPASGSNATVAGWGRLTEGGTVPARLQKVTVPVVDRGTCKVAYSTPTPSEVTENMFCAGLEQGGQDACQGDSGGPIVDTATGALIGVVSWGVGCARPDKYGVYTRLGNYVDFVEKYL

SEQ ID NO: 78 - protein, 255 aa, Metarhizium anisopliae
MASKAALAIASAIFAVQSATAAPAKNGKFIVGGEAAAQGEFPYIVALLSGNFQFCGGTLVNEDTVVTAGHCTSSDVSGIEVRAGSLAWASGGTKVKVRSATRHPDYNGNNYDNDVAVWKLATAIPQSATIKYAKLPAPDSDPAPGANVTVAGWGRLQEGGATPSQLQKVTVPVVDRATCKEAYSTPTPLEITDNMFCAGLPQGGQDACQGDSGGPIVQGDVLLGVVSWGVGCARPNKYGVYTRLGNYVSFIEQYL

SEQ ID NO: 79 - protein, 248 aa, Fusarium oxysporum
MVKFASVVALVAPLAAAAPQEIPNIVGGTSASAGDFPFIVSISRNGGPWCGGSLLNANTVLTAAHCVSGYAQSGFQIRAGSLSRTSGGITSSLSSVRVHPSYSGNNNDLAILKLSTSIPSGGNIGYARLAASGSDPVAGSSATVAGWGATSEGGSSTPVNLLKVTVPIVSRATCRAQYGTSAITNQMFCAGVSSGGKDSCQGDSGGPIVDSSNTLIGAVSWGNGCARPNYSGVYASVGALRSFIDTYA

SEQ ID NO: 80 - protein, 252 aa, Gibberella zeae
MVKITSLVALAAPLVAAAPNPQNSPQIVGGTSASAGEFPFIVSITNNGGPWCGGTLLNANTVMTASHCVQGRSASAFAIRVGSNSRTSGGVTSRVSSIRMHPSFSGSTLNNDVALLKLSTSIPAGGSIAYGRLATSGSDPAAGSSLTVAGWGDTSEGGGVSPVNLLKVTVPVVSRATCRSQYGTSAITDNMFCAGVTGGGKDACQGDSGGPIVDSSKTVVGIVSWGDGCARPNAAGVYARVGTLRSWIDSNA

SEQ ID NO: 81 - protein, 256 aa, Metarhizium anisopliae
MELKSLLAVYLPLCAAPLAAARPASNAVFIVGGSPAAAGEFPFIVSTLLNGRHWCGGVLLNANTVLTAAHCVESTPAISQVRAGSLAHASGGVVANISSITPHPKYEGLGYDMAILKLSTPIEANGTIGYATLPEAGSDPVAGADATVAGWGDLEYAGQAPEELQKVTVPVVDRATCSAAYQAIPNMPNITDAMFCAGLKEGGQDACNGDSGGPIIDTETRVLIGVVSWGYKCAAPNAYGVYTRLGADIEFIKSHL

SEQ ID NO: 82 - protein, 882 aa, Trichoderma reesei
MVRSALFVSLLATFSGVIARVSGHGSKIVPGAYIFEFEDSQDTADFYKKLNGEGSTRLKFDYKLFKGVSVQLKDLDNHEAKAQQMAQLPAVKNVWPVTLIDAPNPKVEWVAGSTAPTLESRAIKKPPIPNDSSDFPTHQMTQIDKLRAKGYTGKGVRVAVIDTGIDYTHPALGGCFGRGCLVSFGTDLVGDDYTGFNTPVPDDDPVDCAGHGSHVAGIIAAQENPYGFTGGAPDVTLGAYRVFGCDGQAGNDVLISAYNQAFEDGAQIITASIGGPSGWAEEPWAVAVTRIVEAGVPCTVSAGNEGDSGLFFASTAANGKKVIAVASVDNENIPSVLSVASYKIDSGAAQDFGYVSSSKAWDGVSKPLYAVSFDTTIPDDGCSPLPDSTPDLSDYIVLVRRGTCTFVQKAQNVAAKGAKYLLYYNNIPGALAVDVSAVPEIEAVGMVDDKTGATWIAALKDGKTVTLTLTDPIESEKQIQFSDNPTTGGALSGYTTWGPTWELDVKPQISSPGGNILSTYPVALGGYATLSGTSMACPLTAAAVALIGQARGTFDPALIDNLLATTANPQLFNDGEKFYDFLAPVPQQGGGLIQAYDAAFATTLLSPSSLSFNDTDHFIKKKQITLKNTSKQRVTYKLNHVPTNTFYTLAPGNGYPAPFPNDAVAAHANLKFNLQQVTLPAGRSITVDVFPTPPRDVDAKRLALWSGYITVNGTDGTSLSVPYQGLTGSLHKQKVLYPEDSWIADSTDESLAPVENGTVFTIPAPGNAGPDDKLPSLVVSPALGSRYVRVDLVLLSAPPHGTKLKTVKFLDTTSIGQPAGSPLLWISRGANPIAWTGELSDNKFAPPGTYKAVFHALRIFGNEKKKEDWDVSESPAFTIKYA

SEQ ID NO: 83 - protein, 884 aa, Trichoderma atroviride
MVRSALFVSLLATITGAIARGSGHASKIVPGAYIFEFENDHDTAEFYKQLNGEGSTRMKFDYKLFKGVSVQLKDLSNHEDKAQKMAQLPAVKNMWPVTLIQAPNPKVEWVAGTNSLPSIQSRDVYPPPTDDGNFPPHKMVQIDKLRAKGYTGKGVKVAVIDTGIDYTHPALGGCYGAGCLVSFGTDLVGDNYSGFNTPVPDNDPKDCAGHGTHVAGIIAAQKNQYGFTGGAPDVTLGAYRVFGCEGQAGNDVLIAAYNKAFEDGAQIITASIGGPSGWAEEPWAVAVTRIVNAGVPCTVSAGNDGDHGLFYASTAANGKKVLAVASVDNQNIPTVFSLSSYKIDSGADTKFGYVPSSKGAEGWKGVTKPVYALTLDTTIADDGCSPLPDNTPDLSDHIVLVRRGSCTFVQKAQNVAAKGGKYLLYYNTIAGALSVEVSSVPQIIGAGMVEDSTGATWIAAIKAGKTVTLSMVALNEATKQVQFADNKATGGALSTYTSWGPTWEMDVKPQISSPGGNILSTYPVALGGYATLSGTSMACPLTAAAVALVAQARSSFDPVLLENLLATTANPQLFNDGTQFYDFLAPVAQQGGGLIQAYDAAFATTLLSPSSLSFNDTDHFISKRQITLKNTSKNRVTYKIGHVPTDTFYTLANSSGYAAPFPNDAVASHASVRLSQQQVTVPAGRSITVDVFPTPPRGVDAKRLGLWSGYITVNGTDGSHLSVPYQGLTGSLQKQQVLFPEDSWISNSTDTNLNPVANGTVFTIPGPGNAGPSDVLPALVVSPALGTRLVRADLVLLSAPPHGSKITTKKFFDTTSIGQPSGSPLLWQSRGPTPISWSGELTDNKFAPPGTYKVVFHALRIFGNEKKKEDWYVSESPAFTIKYA

SEQ ID NO: 84 - protein, 827 aa, Trichoderma atroviride
MKFDYKLFKGVSVQLKDLSNHEDKAQKMAQLPAVKNMWPVTLIQAPNPKVEWVAGTNSLPSIQSRDVYPPPTDDGNFPPHKMVQIDKLRAKGYTGKGVKVAVIDTGIDYTHPALGGCYGAGCLVSFGTDLVGDNYSGFNTPVPDNDPKDCAGHGTHVAGIIAAQKNQYGFTGGAPDVTLGAYRVFGCEGQAGNDVLIAAYNKAFEDGAQIITASIGGPSGWAEEPWAVAVTRIVNAGVPCTVSAGNDGDHGLFYASTAANGKKVLAVASVDNQNIPTVFSLSSYKIDSGADTKFGYVPSSKGAEGWKGVTKPVYALTLDTTIADDGCSPLPDNTPDLSDHIVLVRRGSCTFVQKAQNVAAKGGKYLLYYNTIAGALSVEVSSVPQIIGAGMVEDSTGATWIAAIKAGKTVTLSMVALNEATKQVQFADNKATGGALSTYTSWGPTWEMDVKPQISSPGGNILSTYPVALGGYATLSGTSMACPLTAAAVALVAQARSSFDPVLLENLLATTANPQLFNDGTQFYDFLAPVAQQGGGLIQAYDAAFATTLLSPSSLSFNDTDHFISKRQITLKNTSKNRVTYKIGHVPTDTFYTLANSSGYAAPFPNDAVASHASVRLSQQQVTVPAGRSITVDVFPTPPRGVDAKRLGLWSGYITVNGTDGSHLSVPYQGLTGSLQKQQVLFPEDSWISNSTDTNLNPVANGTVFTIPGPGNAGPSDVLPALVVSPALGTRLVRADLVLLSAPPHGSKITTKKFFDTTSIGQPSGSPLLWQSRGPTPISWSGELTDNKFAPPGTYKVVFHALRIFGNEKKKEDWYVSESPAFTIKYA

SEQ ID NO: 85 - protein, 878 aa, Trichoderma virens
MVRSALFVSLLATISGVIARGSGHPSKVVPGAYIFEFENDQDTADFYKQLNGEGSTRMKFNYKLFKGVSVQLKDLSNHEDKAQKMAQLPAVKNMWPVTLIQAPNPKVEWVASSSSPALQARDVSPTDPSNFPPQQMTQIDKLRAKGFTGKGVKLAVIDTGIDYTHPALGGCFGAGCLVSFGTDLVGDNYSGFNTPVPDNDPMDCAGHGSHVAGIIAAQKNPYGFTGGAPDVTLGAYRVFGCAGQAGNDVLIAAYNKAFEDGAQIITASIGGPSGWAEEPWAVAVSRIVDAGVPCTVSAGNDGDHGLFYASTAANGKKVLAVASVDNANIPTVFSLSSYKVDNGDAQQFGYVSSAKAWKGVNKPIYAVTLDTTIPNDACDPLPDSTPDLSNYIVLVRRGTCTFVQKAQNVAAKGAKYLLYYNTAAGALAVDVSTVTQITAAGMVQDSTGAAWIAALKDGKTVTLSMVNSDEATKQIQFADNKVTGGALSTYTSWGPTWEVDVKPQISSPGGNILSTYPVAKGGYATLSGTSMACPLTAAAVALVGQARKTFDPVLLENLLATTANPQLFNDGAQFYNFLAPVAQQGGGLIQAYDAAFATTLLSPSSLSFNDTDHFVRKRQITLKNTSKQRVTYKLNHVPTNTFYTLTGDSPYPAPFPNDAIAAHATVRLGLEQVTLPAGRSITIDVLPTPPRGVDAKRLGLWSGYITVNGTDGSALSVPYQGLTGSLHKQKVLYPADSWISKSTDENLNPVDNGTVFTIPAPGNAQSTDVLPSLVVSPAFGSRLVRVDLVLLSAPPKNTKVKTTKFLDTTSIGQPAGSPLLWASRGATPLSWSGELTDNKFAPPGTYKAVFHALRIFGNEKKKEDWDVSESPAFTIKYA

SEQ ID NO: 86 - protein, 878 aa, Hypocrea lixii
MVRSAVFLSLLATISGVIARGSGQTSKVVPGAYIFEFENDQDTAAFYKQLNGEGSTRMKFNYKLFKGVSVQLKDLSNHESKAQKMAQLPAVKNMWPVTLIQAPNPKVEWVASSTSPALQARDVSPTDPSNFPPHQMVQIDKLRAKGYTGKGVKVAVIDTGIDYTHPALGGCFGAGCLVSFGTDLVGDNYSGFNTPVPDNDPKDCAGHGSHVAGIIAAQENPYGFTGGAPDVTLGAYRVFGCEGQAGNDVLIAAYNKAFEDGAQIITASIGGPSGWAEEPWAVAVSRIVDAGVPCTVSAGNDGDHGLFFASTAANGKKVLAVASVDNKNIPTVFSLSSYKVDNGDSQQFGYVSSSKAWKGVTKPVYAVTLDTTIPDDACSPLPDSTPDLSNYIVLVRRGTCTFVQKAQNVAAKGAKYLLYYNNIAGALSVDVSTVTQITAAGMVQDSTGAAFIAAIKAGKTVTLSMVDPDSATKQIQFADNKATGGALSTYTSWGPTWEVDVKPQISSPGGNILSTYPVALGGYATLSGTSMACPLTAAAVALVAQARGTFDPALIENLLATTANPQVFNDGAQFYDFLAPVAQQGGGLIQAYDAAFATTLLSPSSLTFNDTDHFVRKRQITLKNTSKQRVTYKLNHVPTNTFYTLSGDSPYPAAFPNEAIAAHASVKLALQTVTLPAGKSITIDVLPTPPKGVDAKRLGLWSGYITVNGTDGSALSVPYQGLTGSLHKQQVLLPEDSWIAKSTDENLNPVENGTVFTIPAPGNAQSTDVLPSLVVSPAFGSRQIRVDLVLLSAPPKNTKIKTTKFLDTTSIGQPAGAPVLWASRGPTPLSWSGELTDNKFAPPGTYKAVFHALRIFGNEKKKEDWDVSESPAFTIKYA

SEQ ID NO: 87 - protein, 885 aa, Metarhizium acridum
MVGLSLVVSLVAAAASALAADAQDKRLVKTFVPGAYIFELEDGHDPATFEQTVGKDGTTRMKLDYELFKGVSVQLHDVDKAHEKAAKLADTPAVKAVYPVQLFNMPKPKVEWIAKDGTKAPGGLLSSRADDGADIFSPHVMTQVDKLRAKGVTGKGVKIAVVDTGIDYKHPALGGCFGHGCLVAFGTDLVGDAYDGSNTPHPDPDPMDCGGHGSHVAGIVAAQPNTFGFTGAAPGATLGAYRVFGCKGQAGNDVLIAAFNQAYQDGANIITASIGGPSGWSEDPWAEAVSRIVDKGVPCTVSAGNEGAEGIFYASTAANGRRVSAIASYDNVQTPSLIYNAKYQIDNGADTKFGYVPSEPASWDGVTLPAWSNSLDPTIPDDGCDPFPANTPDLSNYIVLIRRGSCPFTQKVNNAVAKGAKYVIVYNNNAVGAIPMDLTEVPAGSIKAASMIDGTTGATFINALKDGKKLTLKMVSPQKTDSEVNTSNNTITGGALSTFTSWGPTWEMDTKPQFGAVGGNVLSTYPRALGSYAVLSGTSMSCPQTAGIIALIHEVRGTYDPELIQNLLSANANPQLFNDGTKFYDFLAPVPQQGGGLIQAYDAAYATTLLSPSSLSFNDTDHFVETLKFKLQNTESKKITYKITHTPAITMYALGDGSPSVQPFPNEAVKAVATIKLSETSVTLNGGQSKSISVSPTPPQGLDAKRLALWSGYIVINGTDGTSLSLPYQGLTGSLHKSAVLGANNTWISKSTDKQSNPVPPNSTFLIPAPGNARSNDTLPQLTAALYLGSRKVRADIVPLTTCPPKNLTTEFQGIKTIGQPYNFPALWGTRGLNNFPWDGRLDSGNYAPPGKYRFVVRALRIFGDEKKKEDWDVSTSPALHIKYQ

SEQ ID NO: 88 - protein, 882 aa, Fusarium oxysporum
MVRLSIVAALYAAVVSAVDFDKIAVGKGHSRLPGAYIFEFEENHDCADFFAKASSRGKTRMQYNYKLFKGASIQFTDIDNAEDLASEMALLPGIKQKWPVQTFSIPKPEVHWTGTPGMEYKSIQKRGFEERDAANDTFSPHVMTQIDKLRAEGVTGKGLKVALVDSGIDYKHPALGGCFGKNCLVSFGTDLVGDAYDGSNHAKPDNDPMDCAGHGTHVAGILAAQKNTMGFTGAAPGVQIGAYRAFGCNGEAGNDVLIAAFNQAFEDGADIISASIGGPSGWSEEPWAVAVSRIVEQGVPCVLAAGNAGATGMFYASTAANGKKVTAVGSFDNTKSLALLNASKYSIDGGPEHEFGHLSGKPSAWKGVKLPLWALNYDTSVADDGCDEWPKNTPDLGNYIVLLRRGSCTFDAKAANAVKAGARYIMFYSNKEDLAPFDVSSVGGIKAASIVSPEQGAEWIASLKAKKKITLSMSDGSDGNVILEQKHNNITAGAASTFSSWGPTWEMDVKPQFGAPGGKILSTYPRSMGSYAVLSGTSMASPLVAGIVALIAEARGTRDPALIENLLSASAKPQLFNDGKTFYDFLAPVPQQGGGIVQAHDAAHAKVLLSRSSLSFNDTDHFVESLNFTVKNTGKKQIDLQISHVPAVTMFTLVENYIYPDEFPNDFAKEHASLKFSESKVTIDAGESIVIEVLATPPKGLNATRLPVWSGYVTINGTDGTSLSLPYQGLTGSLHDSMVLGPQDTWIANSTDENRFPLPDNTTWTLPKPGTANNLTDTLPGLTWFLALGSAKLHAEIMPVTTEKPTSSKKPRVIGEPIDFPLLWNAMGANSQAFTGELADGTFAPAGQYVVRYRALRIFGNEKKKEDWDEAYSPVFTIRYEK

SEQ ID NO: 89 - protein, 875 aa, Gibberella zeae
MVRFGLSALLFAGLSLAQDELSQPPQPEQGTVAHLPGAYIFEFEESQDTSVFYDKTESQSTTRVKFDYDLFKGVSVQFDDVASAEELAAKMAALPVVKNVWPVKVYGIPAPRVEWVAEPGMKAPLSKRAVNDTADTFSPHVMTQVDKLRKKGITGHGIKVAVIDTGIDYKHPALGGCFGPDCLVSFGTDLVGDDYDGFNAVHPDDDPMDCAGHGTHVAGIVAAQTNPFGFTGTAPGVTLGAYRVFGCSGEAGNDVLIAAYNQAYQDGADIITASIGGPSGWSEEPWAVAVSRIVEKGVPCPVSAGNSGDVGMFYASTAANGNKVMAIASYDNSDYISLLKQHHYTVDGSDTKIAFGMTAGTPAAWDDVKLPIWAPSLDTTVANGGCDPYPADTPDLSKFIVLVRRGTCTFAQKAQNAANAGAKYFIVYNNAGGANEIDVSAVKSILAAGMVTSKVGAKWIGLLKEGSKVTLEMSAGSDGEVIMEESKNDKTGGAVSTYSSWGPTWEMDVKPQFGSPGGNILSTYPLAKGGYAVLSGTSMACPLVAATIALIAEVRGTLDPETIENLLASTSNPQLFNDGTGFSDYLAPVPQQGGGMIQAYDAAYSTVLMDVSSLSFNDTDNFIKVRNFTIHNTGKKEIDLSVSHIPTKSVYTLDKDSIYASTFPNDVADAHAELKFSEAKLSVGAGEKVTIEVVPSAPEGLDAKRLALWSGYIAINGTGVSLSLPYQGMTGSLHDSVVLGSDDTWIARSNDKDKLTPVPANTTFILPVKGQNATDAQPAPALAWKLALGSAKLEAELIPVGGNSTKSLGAPAGFPVQWNPMGDGNIVWNGKLADGGYAPAGKYKVKYQALRIFGDEKVKSDWDHSESPVFSVKYP

SEQ ID NO: 90 - protein, 906 aa, Epichloe festucae
MVRLRTSFVASLLAAAASTLAADPNEKVANTVVPGAYIFELADGQDAAALEKAVGKDGKTRMRLDFDLFKAVSVQLHDVDKAKEKATKLAALPQVKSVYPVTLYKRPNPKIEWIAQKGSTMQKAALTSRADGPEGPDGPEGAHADTDTYSPHVMTQVDKLRAKGITGKRVKIALVDTGIDFGHPALGGCFGDGCLVSFGTDLVGDDFNGFNTPHPDNIPKDCSGHGTHVAGIIAAQNNTYGFTGTAPDATLGIYRVFGCTGESTNEILIAAFNMAYQGGANIITASVGSASGWSEDPWAEAVSRIVQKGVPCVLSAGNDGDQGIFYASAAADGHRVAAIAAFDNVQTPTVYSNSKYEIDDGPDKVFGYLASKPANWDGVTLPAWANSLDPTVVNDGCQPFPANTPDLSKYIVLIRRGGCNFDKKVGNAIAKGAKNVIVYNNAAAGAAVMDLNSLRPGSLNAASMIDADTGATFIKALKEGKKLTLKMSSPGKTGSTLRTFKNTATGGALSSTTSWGPTWEMDLKPQFGAVGGNILSTFPVALGSYAALSGTSMACPQVAGIMALIHQVRGTYDAELIQNLLSGNSNPQLFNDGTKFYDFLAPVPQQGAGLIQAYDAAYATTVLSPSGLSFNDTDHFAKRLEFKLKNTDKKRATYRVTHVPTITMYTLAKDSIYAQKFPNDHVDAAATLKFSKTSITLRGGEAETVTVSATPPEGLDTKRLALWSGYIVINGTDGASLSLPYQGLTGSLRDSTVLGPSDTWISKSIDEKARKVPPNSVFVIPGPGNAGVNDTLPVLSANLALGSIKVRADIVPLTPCRPNDMIPCPPKDMMTEFWGVKTIGQPYRFPAQWSSRGVNNWAWDGRLDSGNYAPPGKYQFVVRALRIFGDERKKEDWDVSTSPALIIEYQ

SEQ ID NO: 91 - protein, 881 aa, Nectria haematococca
MRLYSLVWLFAAAASAVDIKHIGIKKTSSRLPGAYIFEFEDDNDCSDFYAKASEHGTTRMQYDYKLFKGASIQFNDVDHAEDLAVMMTKMPAVKRSWPVKMISLPTPEVHWQGTPGKDYSAIRRRDLYGRDTTNDTFSPHIMTQVDKLRAEGATGKGIKVALVDSGVDYTHPALGGCFGPGCLVSFGTDLVGDTYNGKNAATPDDDPQDCQGHGTHTAGTLAAQANSMGFTGAAPGVTIGAYRAFGCKGESGNDILIAAFNRAFEDGADIISASIGGPAGWSEDPWAVAVSRIVDQGVPCILSAGNAGEAGLFYANTAGNGKHVTAVASFDNTKSLALFNVSHYTVNDGPKNEFGSLAGAPDAWKGVKLPLWALNYNTTVADDACSPLPANTPDLSKYIVLIRRGTCTFEVKATNLAKFGAQYMMIYSDLENLMPYDVSMVAGIKAAAIVSPSQGLEWMKHLSKGEKVVLEMSDGSDGNVMLQETVNNITAGAVSAFTSWGPTWEMDVKPQFGAPGGEILSTYPRDQGSFAVLSGTSMATPLLAGIVALIAEVRGTLDPIFLENLLSSTSKPQLFNDGKAFYRFLAPVPQQGSGIVQAHDAAHSKIILSPSSLSFNDTDHFVESLNFTLKNTGSEEVEFQISHVPAVTMYTLAKGYMYPDGFPNDFANEQASVRFSESKVSISPGDSIVIEVLPTPPQGVDAKRLPVWSGYVAINGTDGSALSLPYQGLTGSLHDSPVLGPNDTWITSSTDENFFPAKANKTWILPKAGTANNQTDELPAVVWFLALGTAKLHGDIIPVTTDKSSSSGKARVIGEPVNFPLLWNPMGRNSQPFTGELAGGGFAPAGMYVVRYRALRIFGNENDEKDWDESYSPPFAIQYAQ

SEQ ID NO: 92 - protein, 874 aa, Sordaria macrospora
MVRLGLATTLLAAASFAQAAHHKAPKVVPGAYIVEYEDSHAASILNSIKGDATIRKDIRHELFKGASFQFKDLDKAEDLAGKIAAMSGVKAMYPVRRYSVPEHTVHYTGSSVQEVVAKRDTAKDTFTPHLMTQVNKFRDSGITGKGIKVAVIDTGIDYLHPALGGCFGAGCLVSYGADLVGDDFNGSNTPVPDPDPMDCQGHGTHVSGIVASKTNNPYGIIGAASDVTLGAYRVFGCDGDVGNDILIEAYLKAYDDGSDIITASIGGASGWPEDSWAAVVSRIVEKGVPCLVSAGNSGDEGIFYASTAANGKRVTAVGSVDNIIAPALLSEGTYSVAGSSASAFGFTAGTPSAWANVSLPVWSVNFDTTDAANGCEAFPDNTPDLSKYITLIRRGSCTFVQKAQNAAAKGAKYIIFYNNAAGSTKVDISAVAGIQGSAMVTSETGAAWIKALQAGSEVIVNMADPETAPKNLSNFPNPNTAGFLSTYTSWGPTYEIDVKPQISAPGGMILSTYPRALGSYAVLSGTSMACPLAAATWALVMQKRGTKDPRVLENLFSATAHPNLFNDGTTTYPMLAPVAQQGAGLIQAWDAANANALLSISSISFNDTANIKPLQSFEVTNTGKKAVTYQLGHTSAATAYTFADANTIDPADFPNELVANKATLVITPAKLTLNPGQKKTVTVLAIPPKGLDAKRLPVYSGYITLNGTDSTGYSLPYQGVVGSMKAVTVLDKQYSYLSQSSDAALAPVAAGTVFTLPPAGKANETQYANTVYPTVVLTLAMGSAEVRADVVNAKGKTIGQVLTFPAYWNPRGTFEWNWDGALSDGSYAPAGTYKITLRALKIYGNSRKPQDWETQTTESFSIKYAKKNKREFTA

SEQ ID NO: 93 - protein, 886 aa, Glomerella graminicola
MVRSSLLLPLVAAASAVQAYVQSPKTVAGAFIVELEDGQDASEFLAKTKADAVTRMNLNFTLFKGASIQFNDLDTADAKAAQLAQLPSVKNMWPVRTYGIPDSEVVWTGTQGRDYVDVKKRQLGNDTFSTHVQTQVDKLHRNGVTGKGIKVAVIDTGIDYLHPALGGCFGPGCLVSYGTDLVGNNYDGFNEQVPDPDPMDCGGHGTHVAGIIAAQSNPFGFLGTAPGVTLGAYKVFGCEGQVGNDVLIAAYNRAFEEGSNIITASIGGPSGWTDEPWAATVSRIVDAGVPCTVSAGNSGDQGIFFASTAASGRHVTAIASFDNAVTPALLIENTFTVAGGAPSTFAYTPGEPSEWAGVELPLWAITTDSSSDAALGCDPYPAGTPDLSGKIVLVKRGVCTFVVKAQKAAAAGAKYIMVYNNVPGAGSVSVTAVPEILAIGMTTPDQGAAWLKSIAAGSEVVLKMTDPEKAEQILTQSVNTATGGYVSSYSSWGPNWDGQQKPQFGAVGGNVLSTYPRALGSYAVLSGTSMSCPQTAGIVALIAEVRKTLDPATIENLLSAHANPVNFNSGSGPEGLLAPVSQQGAGLVQAYDAAYSTILLSHSSLSFNDTDNFIPELNFTIKNTGSADVSFDLSNVGAATAYTFETAGDLTPALFPNNLTAEHATVAFSESKVSVPAGGEATILVTPTPPTLDAARLPVWSGYIAINGSDGSSMSLPYMGIGGSLHSHVTMDEALMTTSTSATAAEYAPVASNYTYVLPPPGTANKTDAVVPALAIDMVFGSALVRADLVPLTTYPPNITHKVFGTKTLGQPRSFPYTYTSRGVFAVNWDGQMDDGSYAPAGKYKFSVKSLRVFGDASKLEEYDVAETQPFRIIYGAANATAPARH

SEQ ID NO: 94 - protein, 876 aa, Neurospora tetrasperma
MVRLGLATTLLAAASFAQAAQQKAPAVVPGAYIVEYEDSHDPTSILASIKGDATIRKDIRHELFKGASFQFKDLNKADDLASKIAAMSGVKALYPVRRYSIPEHTVHSTGSAVQEVVAKRDTGNDTFSPHLMTQVNKFRDSGITGKGIKIAVIDTGIDYLHPALGGCFGPGCLVSYGTDLVGDDFNGSNTPVPDSDPMDTCNGHGSHVSGVISGNTNNPYGIIGAATDVTLGAYRVFGCSGDVGNDILIEAYLKAYDDGSDIITASIGGASGWPEDSWAAVVSRIVEKGVPCLVSAGNDGATGIFYASTAANGKRVTAVASVDNILAPALLSEASYSVANGSLSTFGFTAGSPSAWANVSLPVWSVNFNTADTANGCEAFPDDTPDLSKYIVLIRRGTCTFVQKAQNAAAKGAKYIIYYNNVSGSTKVDVSAVAGVKAAAMVTSETGVAWIKALQAGTQVTVNMADPETAPKNLNNFPNTATPGFLSTYTSWGPTYEVDVKPQISSPGGMILSTYPRALGSYAVLSGTSMACPLAAATWALVMQKRGTKDPKVLENLFSATAHPNLFNDGTKTYPMLAPVAQQGAGLIQAWDAANANALLSVSSISFNDTEHFKPLQSFEVTNTGKKAVTYQLGHTSAATAYTFANDNSIGPAAFPNELVDAKATLVLTPAKLTLNPGQKKTVTVLAIPPLGLDAKRLPVYSGYITLNGTDSTGYSLPYQGVVGSMRSVTVLDKQNSYLSQSSDATYAPVAAGTTFTLPPAGKANDTLYANTVYPTIVLTLSMGSAEVHADVVNSKGKTIGQVLTFPARWNPRGTFEWNWDGALSDGTYAPADTYKITLKALKIYGNSKWPLDWETQTTEPFTIKYAAKSKRAFTA

SEQ ID NO: 95 - protein, 876 aa, Neurospora crassa
MVRLGLATTLLAAASFAQAAHQKAPAVVPGAYIVEYEDSHDPTSILASIKGDATIRKDIRHELFKGASFQFKDLNKADDLASKVAAMSGVKALYPVRRYSIPEHTVHSTGSAVQEVVAKRDTGNDTFSPHLMTQVNKFRDSGITGKGIKIAVIDTGVDYLHPALGGCFGPGCLVSYGTDLVGDDFNGSNTPVPDSDPMDTCNGHGSHVLGLLSANTNNPYGIIGAAPDVTLGAYRVFGCSGDVGNDILIEAYLKAYDDGSDIITASIGGASGWPEDSWAAVVSRIVEKGVPCLVSAGNDGATGIFYASTAANGKRVTAVASVDNILAPALLSEASYSVANGSLSTFGFTAGSPSAWANVSLPVWSVNFNTADAANGCEAFPDDTPDLSKYIVLIRRGTCTFVQKAQNAAAKGAKYIIYYNNASGSTKVDVSAVADVKAAAMVTSETGAAWIKALQAGTQVTVNMADPETAPKNLNNFPNTATPGFLSTYTSWGPTYEVDVKPQISSPGGMILSTYPRALGSYAVLSGTSMACPLAAATWALVMQKRGTKDPKVLENLFSATAHPNLFNDGTKTYPMLAPVAQQGAGLIQAWDAANANALLSVSSISFNDTEHFKPLQSFEVTNTGKKAVTYQLGHTSAATAYTFANDTSIGPAAFPNELVDAKATLVLTPAKLTLNPGQKKTVTVLAIPPLGLDAKRLPVYSGYITLNGTDSTGYSLPYQGVVGSMRSVTVLDKQNSYLSQSSDATYAPVAAGTTFTLPPAGKANDTLYATTVYPTIVLTLSMGSAEVHADVVNSKGKTIGQVLTFPARWNPRGTFEWNWDGALSDGTYAPADTYKITLKALKIYGNSKWPLDWETQTTEPFTIKYAAKSKRAFTA

SEQ ID NO: 96 - protein, 902 aa, Magnaporthe oryzae
MVGKAIVLSLFAATCLASQATKPVEEKAPIIPGLYIVEYEEGQMDTATLSNEIASDAHVKMNLDFELFKGASIQFHDSAHVEETAAKIAEMPAIKRMWPQRLYRIPDYQVSWAGDMPDAQAKAVMRRQSDGNDTFTPHLMTQVNQLRNKGVVGKGIKVAVIDSGVDWKHPALGGCFGRPECLVSFGYDLVGDAYNGTNTAVPDNDPMDCGGHGTHVSGIIAAQTNNPFGIIGAATGVTMGHYRVFGCEGSASDDVLIQAYNMAYQDGADLITASIAGSSGWPEQAWAVAVTRIVDKGVPCVISAGNDGATGMFFTSSAADARGATAIASFDNSVTPQLLSNATYRVGGGQPVSFSYSAGSPAKWGNVTKQLWAVNFNTNDTQNACDPLPANTPDLSNFIVLIRRGTCPFTQKATNVRAKGAKYVFFYNNVPGTLSISVTAVDGILGAATVSAEIGKSWIAELAAGRNVTLEMTDPLTAPKFLLSAPNSATGGAPSTYTSWGPTFEGQVKPQVAAPGGNILSTYPLAKGGYAVLSGTSMACPLTAGVYALIMSVRGIKDPKTLENLVASTAKPTLFNSGSTSASYLAPVPQQGAGLIQAYDAAYTTTLLSVSSLAFNDTDNFAPVQNFTISNKGSSSVTYTLSQRGAATAFTFSSNASNITPEVFPNELVANYANLKFSEEKLEVGPGGNAQIAVTVTPPSGLDARRLPVYSGYVTINGTDGSSFSLPYMGIAGSIHAQRTLDPQQTFLSSNQIPRNFTEDNPPRVPAGHQFDLPPQGQANNTQYVLVSEMPRFSINLAWGTPLLRADVVALGGNSTAAEQPLAETEVLGLKTVGSLQYFPQRYQARTRSFVRWDGILDSGKYAPSGHYKIVFRALRVFGNSEKQDEYDVVETVPFKIRYINK

SEQ ID NO: 97 - protein, 1006 aa, Chaetomium globosum
MALFSAVEAWHPGLSPGATPSVDGDHPRGGAVRGALSQEGDISLQEHAPHESCYLIYYVQNASDHTVPPQAAPREEARPMYGQVKDELKHSKLSHDIRLQLFPLLWASFLSTSKGILLQRELRNGTCQAQPNSDHPSAGGSARPLCAPPSVDSNAFVNNLGGKASLRKDLRFKLFKGASIQFKDTKNADQMIAKVATMPKIKAVYPVRRYPVPRHVVHSTGDAVEAVLSKRQEGSDTFSTHLMTQVNRFKDKAVTGKGIKIGIIDTGTDYLHPALGGCFGEGCLVSYGTDLVGDKFNGANTPVPDADPLDECNGHGTHVAGIIAAQSNNPYGIVGAAEGVTLGSYRVFGCTGDVGNDILIAAYNMAYEDGSDIITASIGGASGWSEDPWAAVVSRIVDNGVPCVVSAGNDGAAGIFYASTAANGKRVTAIASVDNTVTPALLSNASFSINGTSDFFGFTAGEPGTWDDVTLPLWSVGFDTTDPANGCEPYPDSTPDLSGYIVLVRRGTCAFVDKAANAVAKGAKYVMFYNNVDGTVSVSANVEGVVGVAMVTPEQGEIWVRALEAGSEVVVHMTDPLKAGTFLSSSKNTLSGGFLSDFTSWGPTYEVEVKPQFSTPGGLILSTYPRALGSYGVLSGTSMACPMAAAIYALLMTARNTKDPKTLENVLSATARPNVFRLQGKSLPVLAPVAQQGAGLLQAWDAARATTLLSVSSISFNDTDNFSPVQNFSISNTGATAVTYSLSNIGAATAYTFNDEKTISPAAFPNELTGDFASLSFSPSNFTIPAGQRKIITVTATPPKGVNVKRLPVYSGYIAINGSDSSALSLPYLGVAGSMRSVVVLDSKAALISSARDQSNTPVPAGVTFVLPPPGFSNDSSYANRTERPKLVVSLAMGSAVLRADIVPVSNCTTVARTAGVVFGTKTIGQPEGLPALWNPRGRFEYSWDGKLDDGTYAPAGRYKFAVKALRIFGDREEVADYDAAETTDFRIRYLPAPSAKFRRQEQGCE

SEQ ID NO: 98 - protein, 541 aa, Trichoderma reesei
MRSVVALSMAAVAQASTFQIGTIHEKSAPVLSNVEANAIPDAYIIKFKDHVGEDDASKHHDWIQSIHTNVEQERLELRKRSNVFGADDVFDGLKHTFKIGDGFKGYAGHFHESVIEQVRNHPDVEYIERDSIVHTMLPLESKDSIIVEDSCNGETEKQAPWGLARISHRETLNFGSFNKYLYTADGGEGVDAYVIDTGTNIEHVDFEGRAKWGKTIPAGDEDEDGNGHGTHCSGTVAGKKYGVAKKAHVYAVKVLRSNGSGTMSDVVKGVEYAALSHIEQVKKAKKGKRKGFKGSVANMSLGGGKTQALDAAVNAAVRAGVHFAVAAGNDNADACNYSPAAATEPLTVGASALDDSRAYFSNYGKCTDIFAPGLSIQSTWIGSKYAVNTISGTSMASPHICGLLAYYLSLQPAGDSEFAVAPITPKKLKESVISVATKNALSDLPDSDTPNLLAWNGGGCSNFSQIVEAGSYTVKPKQNKQAKLPSTIEELEEAIEGDFEVVSGEIVKGAKSFGSKAEKFAKKIHDLVEEEIEEFISELSE

SEQ ID NO: 99 - protein, 537 aa, Trichoderma atroviride
MRSVIALSVAAVAQASSFQVGTIHESSAPVLSNIEANAIPDNYIIKFKDHVDEAGADKHQNWIQSIHDEGEQQRLELRKRSSIFGADEAFDGLKHTFKIGDFKGYAGHFTEDIIEQVRNHPDVEYIERDTIVHTMLPLDSQDSVVVEDSCNPETEKQAPWGLARISHRDTLGFGTFNKYLYTADGGEGVDAYVIDTGTNIEHVDFEGRAKWGKTIPAGDEDEDGNGHGTHCSGTVAGKKYGVAKKAHVYAVKVLRSNGSGTMSDVVKGVEYAALSHQEQVKQAKAGKRKGFKGSVANMSLGGGKTSALDAAVNAAVKAGVHFAVAAGNDNADACNYSPAAATEPVTVGASALDDSRAYFSNYGKCTDIFAPGLSIQSTWIGSKYAVNTISGTSMASPHIAGLLAYYLSLQPAGDSEFAVAPITPNKLKKDLITIATQGTLSDIPADTPNLLAWNGAGCSNYSQIVKAGGYKAKAQKQTKLPATIEELEDAIEGDFEVVSGKIVKGAKSFGSKAEKFAKKIHDLVEEEIDEFMSELSE

SEQ ID NO: 100 - protein, 1670 aa, Trichoderma virens
MRSVVALSVAAVAQASSFSIGTIHESSAPVLSTVEANAIPDAYIIKFKDHVGEADADKHHNWLQNIHSSGEQERLELRKRSNIFGSDDAFAGLKHTFKMDGFKGYAGHFHESVIEQVRNHPDVEYIERDSIVHTMLPLESKDTIIVEDSCNGETEKQAPWGLARISHRETLNFGSFNKYLYTAEGGEGVDAYVIDTGTNIDHVDFEGRAKWGKTIPAGDEDEDGNGHGTHCSGTVAGKKYGVAKKAHVYAVKVLRSNGSGTMSDVVKGVEWAALAHIEAVKQAKAGKRKGFKGSVANMSLGGGKTQALDAAVNAAVNAGVHFAVAAGNDNADACNYSPAAASAPLTVGASALDDSRAYFSNYGKCTDIFAPGLSIQSTWIGSKYAVNTISGTSMASPHICGLLAYYLSLQPAGDSEFAVAPITPKKLKENIVSIATKGALSDLPDSDTPNLLAWNGGGCSNFSQILEAGSYTVKPKAKHAKLPATVSELEKAIEGDFEVVSGKIVKGAKTFGSKAEKFAKKIHDLVEEEIEEFISELSDNGHNAPMRLSVRGFMDRYQERLVLFLGIRHALWARSHGFIFAFSYYSYLASPIWLRKTQMAASCQKPQSLTRKAGAKRCKTGSFRTIWQNGFFRYGRRHRRLLPLNWQEHAKRKTKISPSHYHSTRHRHLLHIVGQGVTIRATSLRSLYSLNNDNASQEQLQKPESSPPEQEQPYAAERDAYLAATLSYNRAQPQSNGGGKASRLHRQQSVRFAGPNAQPQRRLAARASMALVGNINMPRRPVGSQHLSQSSFEPGEDAASLSYARLRKSRSMYTPSIPNTPTYTMDSGDSVDVLNGWLPTPQIRKENEPLRSFGGPALRSPKSMGFLSNDCEISTSRASISSGHASVQQTRNGFYEPSERSSRLQSRPSSFFRSSYRHAPNPTSFPKSLRGSSNNTSFLSSESIYGAKFPPQIPSEQPGLRKKARKISKSLKSRIKGLFSRPKNRDDIVDQTEEHPQDLESNNGSSYSSQTPARLSHEASLYRVISHMPSFHAVPPSQQLRSRQGSLGTIEVEDNTLDDDKSRVTSWTNSTADTISNQLSANWSRQYPSLLQDDMDTTLSPHNQTSMYRKNMINTGPIVNSQRVYSALMKRLQEKNGHQNQSLGEDHMTPDPVETNSLRSTSTIRRQTRQAMYAGSTHTIRHVQYDDDVFQDSVEGSTTSRYSSESTKSVIRRHQSSDSLQDYGHKSCPSPGSGNVSGFPPNTNDVKPHPVTENQKPTLSGRSSAFFASPTCHLFRTTSPYRRALQESMRAAQASNQPQTPGTKHLSSLSALSLPIRRPSTEESDDDARVAYAESVYSNSSEENAPQVDEPSPPLRSTEEEPRPQVHGDATIFLNTERPRLPPPSHTRDSSSASSVEWKTWLSANVSKLETPPTTLKPDLSQEPSSAPQTFSHVREKTEIDSDVDDYPQDAPGGGLSPKLGLSKDNHSPSVLTPIPRGKFHLVNPWHLQSTASNENSPPTSGVRSKSACSKDASPVAPKGHLRTIPSVPNVNTCATNAESLMGEPRNPSLNTCSKPFDPVREEARLKRRSRTRLGANDASAKSSPGFTTALKRQFGVSRTGSPGVWKAEEPSGELGSEADPGVDELGRRDFDAQAMGSRRMVDLFLSSRRQRIAGSQTRQSSDSLSAAFI

SEQ ID NO: 101 - protein, 538 aa, Hypocrea lixii
MRTAVALSVAAVAQASTFQIGTIHENSAPVLSTVEANAIPDAYIIKFKDHVGEAQAEKHHDWLQSVHSSGEQERLELRKRSSIFGSDDVFDGLKHTFKMDGFKGYAGHFHESTIEQVRNHPDVEYIERDSIVHTMLPLESKDNIIIEDSCSPETEKQAPWGLARISHRDTLNFGSFNKYLYTAEGGEGVDAYIIDTGTNIEHVDFEGRAKWGKTIPAGDEDEDGNGHGTHCSGTVAGKKYGVAKKAHVYAVKVLRSNGSGTMSDVVKGVEFAAISHQEAVKQAKDGKRKGFKGSVANMSLGGGKTSALDAAVNAAVKAGIHFAVAAGNDNADACNYSPAAASEPVTVGASALDDSRAYFSNYGKCTDIFAPGLSIQSTWIGSKYAVNTISGTSMASPHIAGLLAYYLSLQPATDSEFAVAPITPNKLKKDIISVATVGTLSDIPSDTPNLLAWNGAGCSNYSQIIEAGSYTAKPKANKAKLPATIEELEEAIEGDFEVVSGKIVKGAKTFGSKAEKFAKKIHDLVEEEIEEFISELSE

SEQ ID NO: 102 - protein, 495 aa, Aspergillus fumigatus
MKGYLSLSILPLLVAASPVVVDSIHNGAAPILSSMNAKEVPDSYIVVFKKHVNAESAAAHHSWVQDIHSAQNERVELRKRSLFGFGEEAYLGLKNTFDIAGSLVGYSGHFHEDVIEQVRKHPDVEYIEKDSEVHTMEDPTVEKSAPWGLARISHRDSLSFGTFNKYLYASEGGEGVDAYTIDTGINVDHVDFEGRAQWGKTIPTDDEDADGNGHGTHCSGTIAGRKYGVAKKANLYAVKVLRSSGSGTMSDVVAGVEWAVKSHLKKVKDAKDGKIKGFKGSVANMSLGGGKSRTLEAAVNAGVEAGLHFAVAAGNDNADACNYSPAAAENPITVGASTLQDERAYFSNYGKCTDIFAPGLNILSTWIGSKHAVNTISGTSMASPHIAGLLAYFVSLQPSKDSAFAVDELTPKKLKKDIIAIATQGALTDIPSDTPNLLAWNGGGSSNYTDIIASGGYKVNASVKDRFEGLVHKAEKLLTEELGAIYSEIHDAAVA

SEQ ID NO: 103 - protein, 530 aa, Nectria haematococca
MRTALTLSLAAVANAASFSVGTIHDRSAPILSSIEAETIPDSYIIKFKDHVDETAASDHHTWIQNIHSHGEQERLELRKRSTPFTDKTFAGLKHTFNIGKGFKGYAGHFDESVIEQVRNHPDIEFIERDTLVHTMIPVQNQDAVSEYKCDDGKTETSAPWGLARISHRDTLNFGTFNKYLYSADGGEGVDAYIVDTGTNIDHVDFEGRAHWGKTVPAGDADEDGNGHGTHCSGTVAGKRYGVAKKANVYAVKVLRSNGSGSMSDVVKGVEFAATSHLEQAQKAKDGKRKGFKGSVANMSLGGGKTQALDAAVNAAVRTGVHFAVAAGNDNADACNYSPAAAAEPVTVGASALDDSRAYFSNYGKCTDIFAPGLNIQSTWIGSKYAINTISGTSMASPHIAGLLAYYLSLQPAEDSEYAMASITPKKLKENLISIATENALSDIPSDTPNLLAWNGGGCSDYKKIVEAGSYQVNKASPSSPAKQIKDAVEQEIGVVSGKVKEFGSKAEKFSKKIHNLVDEELEQFLKEINM

SEQ ID NO: 104 - protein, 533 aa, Gibberella zeae
MKSALTLSMAAVASAASFSVGTVHDKAAPILSSVDAETIPDSYIIKFKDHVDEHAASNHHMWVQDTHTQGESERMELRKRSIPFTDKTFSGLKHTFDIGEAFKGYAGHFDESMIEKVRNHPDVEFIERDTLVHTMVPITNNDMVTEDKCDGETERSAPWGLARISHRNTLNFGSFNKYLYSSDGGEGVDAYIVDTGTNIKHVDFEGRAHWGKTIPSGDADEDGNGHGTHCSGTVAGKKYGVAKKASVYAVKVLRSNGSGSMSDVVKGVEFAATSHLEQKKKAKDGKRKGFKGSVANMSLGGGKTQALDAAVNAAVRTGIHFAVAAGNDNADACNYSPAAASEPVTVGASAIDDSRAYFSNYGKCTDIFAPGLNIVSTWIGTDKAINTISGTSMASPHIAGLLAYYLSLQPAEDSEYALASITPKKLKENLISVATENALSDIPSDTPNLLAWNGGGCSDYKKIVEAGSYKVNKAAPSSRVEDIKHAVEQEVEVVSGKLTTGAKQLGSKAEKFSKKIHELVDEELEQFIKELNL

SEQ ID NO: 105 - protein, 532 aa, Isaria farinosa
MKSFVAALSVAAIAQASSFKIGTIHHDSAPILDATHANTIPGAYIIKFKEHVDEPKAKTHHAWVTDIHGDGQQQRIELRKRGLFDSVEDVFDGVKHTFDLGAGFRGYAGHFDDAVIEQIRNHPDVEAIERDSIVHTMVPVSAKDTVTEDTCNPETEKQAPWGLARISHRKTLGFGTFNKYLYAEDGGEGVDAYVIDTGTNIAHVDFEGRAKWGYTAPDGDADEDGNGHGTHCSGTIAGKKYGVAKKANVYAVKVLRSNGSGTMSDVIKGVDWAAKSHEQQVKDAKAGKRKGFKGSVANMSLGGGKTTLLDIAVDAAVAKGLHFAVAAGNDNADACNYSPAAAKNAVTVGASTIDDSRAYFSNYGKCTDIFAPGLNIQSTWIGSKYAINTISGTSMASPHICGLLAYYLSLQPASDSEYAVASITPAELKDNLITIGTKNTLSDIDSDTPNVLAWNGAGCSDYKKIVEAGAYDAKRTSSKSENIHTKIQHEFEIVSGEITKSAKTFGSKAEKFAKKIQHIVDAEVEDFLSHME

SEQ ID NO: 106 - protein, 537 aa, Glomerella graminicola
MRGFIGAVAGLAAVASATPSLSIETIHDGAAPVISSTNAEAVPNSYIIKFKKHVSDTDAEDHHNWVQQIHSSSQDERLELRKRGQEPLVDNVFHGLKHTYKIGNDFLGYAGHFDEATIEKIRRHSDVEFIEVDSVVHTQVPVKSQGAEAEDTCDGELEKLAPWGLARVSHRKSLGFGTYDKYLYAEDAGEGVDAYVIDTGTNVDHVDFEGRAKWGKTIPSGDQDVDGNGHGTHCSGTIAGKKYGVAKKANVYAVKVLRSNGSGTMSDVVKGVEWAATSHIEQVKAAKDGKRKGFKGSVANMSLGGGKTQALDAVVNAAVDAGIHFAVAAGNDNADACNYSPAAAEKAVTVGATELGDRRSYFSNYGKCTDIFAPGTNIKSTWIGSKYAVNTISGTSMASPHICGLLAYYLSLQPSTDSEYSVAPITPQKLKKALISVGTVGALADIPRDTPNVLAWNGGGCSNYSAIIEAGSYTVKQETKEATIDDLEKAIEEDFEVLSGKVVKGAKNIGTKAEKLAKKIHNLVDEELKEFLRETSL

SEQ ID NO: 107 - protein, 531 aa, Epichloe festucae
MKTILALSVAAVAQAAFSTETIHKGSAPVLSSIHADVVPDSYIIKFKDHVDEAKANEHHAWVKDIHTGGEEDRFELRKRGLGSSIVDAFSGTKHTFNFDGFKGYSGHFHESVIEKVRNNPDVEFIEKDTVVHTMLPLTSEHSVQEDKCDPGETEKQAPWGLARLSHRDSLRFSTYNKYLYATEGGEGVDAYVIDTGTNVDHVDFEGRAKWGKTIPSGDADEDGNGHGTHCSGTIAGKKYGVAKKAHVYAVKVLRSNGSGSMSDVVKGVEFAANSHTEQVKAAKDGKRKGFKGSVANMSLGGGKTSALDAAVNAAVKVGIHFAVAAGNDNADACDYSPAAAEHPVTVGASAFDDSRAYFSNYGKCTDIFAPGLNILSTWIGSKYAVNTISGTSMASPHICGLLAYYLSLQPAKDSEYSVAAMTPKDLKDALIEVSTEGVLSDIPSDTPNKLAWNGGGCNNYSKIVAAGGYKAKSEASELKKIEKVAMDEAKEISGKVVKGVKHLGEKTEKFVEKVHSVVDKEIEHFISEISS

SEQ ID NO: 108 - protein, 533 aa, Metarhizium acridum
MHTLVAAVALSVVGVAQAGFSIETIHKESAPILSSVDAEVVPDSYIIKFKDHVNEAAANDHRSWIQSIHKDGEEERLELRKRSLGSSPVEAFAGLKHTYNIANGFKGYSGHFHESVIEKVRNHRDVEFVEKDTIARILRPVISDESAQEDCTPETERQAPWGLARVSHRKGLSFGTYNKYLYAADGGEGVDAYVIDTGTNTEHVDFEGRAKWGKTIPAGDADEDGNGHGTHCSGTIAGKKYGVAKKANVYAVKVLRSNGSGTMADVVKGVEFAATNHVEQVLLAKDGKRKGFKGSVANMSLGGGKTQALDAAVNAAVKAGIHFAVAAGNDNADACNYSPAAAELPVTVGASAFDDSRAYFSNYGKCTDIFAPGLNILSTWIGSKTAVNTISGTSMASPHICGLLAYYLSLQPAGDSEFSVAPITPKQLKDTLIEISTQGVLTDIPKDTPNKLAWNGGGCSNYSKIVAAGGWTGKSKTSETKPVENAVKEEMKVLSNKVSEGVKDLGDKTEKFVAKIHDVVDKEIEHFISEISL

SEQ ID NO: 109 - protein, 535 aa, Acremonium sp.
MRAVIALSFAAYASAAPRVSFETIHGDAAPILSASNAEIIPNSYIIKFKKHVTDDSASAHHSWIQEIHTSRESERADLKKRGQIPLVDDVFRGLKHTYKIGQEFLGYSGHFDDEVIEQVRRHPDVEYIERDSIVHTMRVAENAQCDSELEKAAPWGLARISHRNTLSFATFNKYLFAAEGGEGVDAYVIDTGTNIEHVDFEGRAKWGKTIPSGDADVDGNGHGTHCSGTIAGKKYGVAKKANVYAVKVLRSNGSGTMADVVAGVEWAAKAHLEQVKAAKDGKRKGFKGSVANMSLGGGKTKALDDTVNAAVSVGIHFAVAAGNDNADACNYSPAAAEKAVTVGASAIDDSRAYFSNYGKCTDIFAPGLSILSTWIGSKYATNTISGTSMASPHICGLLAYYLSLQPASDSEYSVAPITPEKLKSNLLQIATQDALTDMPKGTPNLLAWNGGGCNNYTAIVEAGGYKVERQSKTDKIDIGKSVSELEKLIEHDFEVVSGKVVKGVSSFAGKAEEFSKKIHQLVDEELKDFLEDIAA

SEQ ID NO: 110 - protein, 503 aa, Ophiostoma piliferum
MSLASVAVAAPSFTTGTVHGDAAPILASVNTEAIPNSYIVKFKNHVNEKDVSTHHSWVQSLHDQGEEKRLELRRRGMDFGILSGVKHTFKIGETFKGYAGQFDDELIEQLRRHPDVEYIEKDTVVHTMQPVSSEETCSSEVEKNSPWGLARISHRDTLSFGTFNKYLYSSEGGEGVDVYVIDTGCNVDHVDFEGRATWGKTIPSGVSDLDGNGHGTHCSGTIAGKKYGVAKKARVYAVKVLRSNGSGTMSDVVKGVEWAANAHLEALKQAKAGKRKGFKGSAANMSLGGGKTVALEEVVNAAVEAGVHFAVAAGNDNADACNYSPAAAQNAVTVGASALDDSRAYFSNWGKCTDIFAPGLSIQSTWIGSKHAVNTISGTSMASPHIAGLLAYYLSLQPAADSEYAVAAITPAELKANIISIATEGALSDLPKDTPNVLAWNGGGCSNYSSILEQGSYKVKSSKNSKLDIEALEKAIENDLNIVSGQIVKGAESLASKAQKFST

SEQ ID NO: 111 - protein, 532 aa, Neurospora tetrasperma
MRGLLALSLAACAAAAPAVSHESIHGDAAPILSSSNAEVVPNSYIIKFKKHVTDDKISDHHTWIQKIHSSRMDLKKRSQIPMVDDVFRGLKHTYKIGQDFMGYSGHFDEDTIEAVRRHPDVEYIERDSIVHTMSVSEDVDSEGKCDSDIEKSAPWGLARISHRDTLSFATFNKYLYAAEGGEGVDAYVIDTGTNVEHVDFEGRAKWGKTIPNGDADVDGNGHGTHCSGTIAGKKYGVAKKASVYAVKVLRSNGSGTMADVVAGVEWAAKSHLEQVKAAKDGKRKGFKGSVANMSLGGGKTQALDDTVNAAVSVGIHFAVAAGNDNADACNYSPAAAAKAVTVGASAIDDSRAYFSNYGKCTDIFAPGLSILSTWIGSKYATNTISGTSMASPHICGLLAYYLSLQPSSDSEYSLATISPEKMKANLLKIATVGALSDMPRDTPNLLAWNGGGCSNYSAIVDAGSYKATPKAQSDKISSVSELEKAIEHDYEVISGKVVKGVSSLSDKAEKLSEKIHDMVEEELKEFLEEIAH

SEQ ID NO: 112 - protein, 532 aa, Chaetomium thermophilum
MRGLFFLSLAAYAAAAPRAKVGTIDNDAAPILSSSNAEIVPNAYIIKFKKHVTPEVAAAHHTWIQEIHSAAETRRLDLKKRSQFPFVDQVFHGLKHTYQIGQEFLGYAGHFDDETIEQVRRHPDVEYIERDTIVHTMRFEEAKEECHGEIEKSAPWGLARISHRDTLTFSTFNKYLYAAEGGEGVDAYVIDTGTNIEHVDFEGRAKWGKTIPAGDADVDGNGHGTHCSGTIAGKKYGVAKKANIYAVKVLRSNGSGTMSDVVAGVEWVATQHLENVKLAKAGKRKGFKGSVANMSLGGGKTRTLDDTVNAAVAVGVHFAVAAGNDNADACNYSPAAAESAITVGASAIDDSRAYFSNYGKCTDIFAPGLSILSTWIGSKYATNTISGTSMASPHIAGLLAYYLSLQPSEDSEYSVAPITPKKMKENLLKIATEGALSDLPRDTPNLLAWNGGGCSNYSAIIEAGGYKVERKSQSSKIEIPTSFSDVEEELKSISKKVHEGASSFADRAKKFTEKIHKLVDEELKEFIEELGA

SEQ ID NO: 113 - protein, 510 aa, Metarhizium flavoviride
PFVAAVALSVVGVAQAGFSIETIHKESAPILTHVDAEVVPDSYIIKFKDHVNEAAVNDHHSWIQSIHKDGEEERLELRKRSLGSSPVEAFAGLKHTYNIASGFKGYSGHFHESIIEKVRNHGDVEFIEKDTIARILRPVTPDESVQEDCTPETEKQAPWGLARVSHRKGLSFGTYNKYLYAADGGEGVDAYVIDTGTNTDHVDFEGRAKWGKTIPAGDADEDGNGHGTHCSGTIAGKKYGVAKKANVYAVKVLRSNGSGTMADVVKGVEFAATRHVEQVLRAKDGRRKGFKGSVANMSLGGGKTQALDAAVNAAVKAGIHFAVAAGNDNADACNYSPAAAELPVTVGASAFDDSRAYFSNYGKCTDIFAPGLNILSTWIGSPTAVNTISGTSMASPHICGLLAYYLSLQPAGDSEFSVASITPKQLKETLIDISTQGVLTDIPNDTPNKLAWNGGGCSNYSKIVAAGGYIGVPRTSEPKPVGNAVKEEMKVLSHKVSQGVKDLGDKTEKG

SEQ ID NO: 114 - protein, 531 aa, Podospora anserina
MKGYAILSLAAAAAAAPSASIETIHGEAAPILSSANAEVIPNAYIVKFKKHVTEEKVSDHHTWIQELHTTRENERIDLKKRGQFPLVDDVFHGLKHTYKVGSEFLGYAGHFDEETIEKVRRHPDVEYIERDSIVHTMRVIEDAKCDSEIEKAAPWGLARISHRDTLGFSTFNKYLYAAEGGEGVDAYVIDTGTNVDHVDFDGRAKWGKTIPSGDADVDGNGHGTHCSGTIAGKKYGVAKKANVYAVKVLRSNGSGTMSDVVAGVEWAAKSHIQAVKEAKDGKRKGFKGSVANMSLGGGKTKTLDDTVNAAVSVGIHFAVAAGNDNADACNYSPAAAAKAVTVGASGIDDSRAYFSNYGKCTDIFAPGLSILSTWIGSKYATNTISGTSMASPHIAGLLAYYLSLQPATDSEYSLAPITPEKLKDNLLKIATEDALTDMPKGTPNLLAWNGAGCNNYTAIVEAGGYKVKKTEGTKADFDVSKLEELIENEYDVISGQVVKGVSSLSEKARKFSKKIHEMVDEELKEFLEELA

SEQ ID NO: 115 - protein, 536 aa, Magnaporthe oryzae
MKSVILLSLAACAVAAPTAGVETIHDGAAPILSSSNAEAIPNAYIIKFKKHVDHKSAADHQMWIQKVHGEREDERLELRKRGLFDSVNDAFTGLKHTYNVGSGFLGYAGHFDEETIEKVRRHPDVEAIERDTIVHTMRYEEVKKDECNPDLEKGAPWGLSRVSHRESLSFSTYNKYLYSAEGGEGVDAYVIDTGTNIDHVDFEGRAHWGKTIPANDQDIDGNGHGTHCSGTVAGKKYGVAKKAQVYAVKVLKSNGSGTMSDVIAGVDFAAKSHKAQVSAAKDGKRKGFKGSVANMSLGGGKTTLLDAAVNAAVDAGIHFAVAAGNDNADACNYSPAAAAKAVTVGASALDDSRAYFSNWGKCTDIFAPGLNIQSTWIGSKTAINTISGTSMASPHIAGLLAYYLSLQPASDSEYSLATITPEKLKADLIKVGTVGILTDIPKDTPNVLAWNGGGCSNYFEIVSKGGYKAKAQADKSSSLLDSVTELEKAIEHDFRVISGKVVKEASSMTGQAEKLSEKIHQAVDEELKHFFGEARV

SEQ ID NO: 116 - protein, 522 aa, Sclerotinia sclerotiorum
MRGLVSLSLLPLLASSAPTFSTETIHEGVAPLLSSSNSVAVPDSYIVVFKKHVTEASATEHHSWVQDIHSNGEAQRTELRKRGQFPITTDIFEGLKHTYNIAGDFLGYSGHFDDSVIEEVRRHPDVEYVEKDSIVHTLGDSEGEIEKNAPWGLARISHRDSLSFGTFNKYLYAADAGEGVDAYVIDTGTNTEHVDFEGRAHWGKTIPAGDADEDGNGHGTHCSGTVAGKKYGVAKKANVYAVKVLRSNGSGTMADVVKGVEWAANSHTKKVKEGKKGFKGSVANMSLGGGKSPALDRAVNGAVAAGIHFAVAAGNDNADSCNYSPAAAENAITVGASAVDDSRAYFSNYGTCNDIFAPGLSILSTWIGSKYAVNTISGTSMASPHICGLLAYYLSLQPSSDSAYAVAEITPKKMKENLLSVATEGALSDVPSNTKNILAWNGGGSSNYTSIIKAGGYAAKASKKVPTTVELLEKAIENDFNMLSGKVVKGGESIVSKTEELSKKIQKIVDEEISEFFEEFSS

SEQ ID NO: 117 - protein, 491 aa, Talaromyces stipitatus
MKGILGLSLLPLLTVASPVMPSTIHNDAAPILSSSNAVEVPDSYIIVFKNHVDPASAAAHHSWVQDIHNQHTELRKRSQFPFAGDVFAGLKHTFDIAGSFLGYSGHFDENVIEAIRRHPDVDYIEKDSIVHTMEDPTTEKNAPWGLARISHRESLSFGSFNKYLYAADGGEGVDVYVIDTGTNIDHVDFEGRASWGKTIPTDDEDVDGNGHGTHCSGTIAGKKYGVAKKANVYAVKVLKSNGSGTMSDVVQGVEWAATQHIKKVKDAKAGKAKGFKGSAANMSLGGGKSVTLDRAVNAAVDAGIHFAVAAGNDNADSCNYSPAAAEKAVTVGASTLADERAYFSNYGKCNDIFAPGLNILSTWIGSKYAVNTISGTSMASPHIAGLLAYFLSLQPASDSAFAVAEITPKKLKENLITIGTQGVLTDVPSDTTNILAWNGGGSSNYSDIIAKGGYKTKSVSDQVDDLIIKAQEVVNEELGAIYSHIKDAVVA

SEQ ID NO: 118 - protein, 256 aa, Trichoderma reesei
MFIAGVALSALLCADTVLAGVAQDRGLAARLARRAGRRSAPFRNDTSHATVQSNWGGAILEGSGFTAASATVNVPRGGGGSNAAGSAWVGIDGASCQTAILQTGFDWYGDGTYDAWYEWYPEFAADFSGIDIRQGDQIAMSVVATSLTGGSATLENLSTGQKVTQNFNRVTAGSLCETSAEFIIEDFEECNSNGSNCQPVPFASFSPAITFSSATATRSGRSVSLSGAEITEVIVNNQDLTRCSVSGSSTLTCSYV

SEQ ID NO: 119 - protein, 256 aa, Trichoderma atroviride
MKFITGIAISALLCADAALAGVAANRGLARRLARRAGRRSAPFKNNTLHASVQSNWGGAILQGSGYSAASATVNVPTGGGGSSAAGTAWVGIDGDTCDSAILQTGIDWYGDGTYDAWYEWYPEFSADFSGIDISAGDQIAMSVVATSLTGGSATLENLTSGQKVTQNFSKVTAGSLCETSAEFIIEDFEECNENGSDCQFVPFASFSPAVKFSSASATQNGRTVSLSGAVLTEVEINNKDVTKCSVSGSTLTCSYV

SEQ ID NO: 120 - protein, 256 aa, Trichoderma virens
MMFVAGVALTALLCADAALAGVAQNRGLAARLARRAGRRSAPMRNNTSHATVQSNWGGAILEGSGFTAASATVNVPKGGGGSSAAGSAWVGIDGATCDSAILQTGFDWYGDGTYDAWYEWYPEFAADFTGIDINQGDQIAMSVVATSLTGGSATLQNLSTGQKVTQTFSRVTAGSLCETSAEFIIEDFEECNSNGSNCQPVPFASFSPAIQFTSASATRSGQKVSLSGAVMSEVIVNNKDLTKCSVSGSTLTCSYV

SEQ ID NO: 121 - protein, 271 aa, Aspergillus flavus
MKLFAILSSTVLASVALASPLTLERRARNAARLQARVAQRHSNLPFKAGTNEILHLNETTHEEYSSNWAGAVLIGSGYTSVTGTFTVPTPSAPSGADSDEQYCATAWVGIDGDTCQSAILQTGVDFCIDSSGTTFDAWYEWFPDYSHDFSGISISAGDKVKVTVDASSKTAGTAIVENLTTGKTVSHTFTGQDDNALCETNAEWIMEDFSSFLSLVPFANFGTVTFTDISATSGDSSVGASNATIIDIQQNNKTLTSSSASDTEVTIKYIG

SEQ ID NO: 122 - protein, 265 aa, Aspergillus niger
MKTTALLTAGLLATTAMAAPLTAKRQAARAKRSTNRQSNPPFKPGTNEVLALNGTKNVEYSSNWAGAVLIGTGYTAVTAEFVVPTPSVPSGGSSREEYCASAWVGIDGDTCDTAILQTGVDFCVQGSEVSFDAWYEWYPDYAYDFSGISISAGDTIKVTVDASSDTTGTATIENVSTGTTVTHSFTGGVDGDLCEYNAEWIVEDFEEDDSLVPFADFGTVTFTSCSATKDGSSVGPEDATIIDIEQNEVLTSVSVSSSEVVVKYV

SEQ ID NO: 123 - protein, 268 aa, Aspergillus terreus
MKLSVLSSILLAGTAVAAPLTAQRQARNARRVARAANRSSHPPYKPDSSELLHLSNTTHVEYSSNWAGAVLIGTGYTAVTGEFTVPTPSTPSGSSSSKEYCASAWVGIDGDTCSTAILQTGVDFCVQGSSVSFDAWYEWYPDYAYDFSGITISAGDTIRVTVDATSKTAGTATVENLTTGKTVTHTFTGGVDGSLCEYNAEWIVEDFEENGSLVPFADFGTVTFSSAEATDGGSTVGPSGATVIDIEQSNKVLTSVSVGSSSVTVKYV

SEQ ID NO: 124 - protein, 260 aa, Scytalidium lignicola
MKFTTAAVLSALVSAEIAFAAPGGNGFARRQARRQARAAGLKASPFRQVNAKEATVESNWGGAILIGSDFDTVSATANVPSASGGSSAAGTAWVGIDGDTCQTAILQTGFDWYGDGTYDAWYEWYPEVSDDFSGITISEGDSIQMSVTATSDTSGSATLENLTTGQKVSKSFSNESSGSLCRTNAEFIIEDFEECNSNGSDCEFVPFASFSPAVEFTDCSVTSDGESVSLDDAQITQVIINNQDVTDCSVSGTTVSCSYV

SEQ ID NO: 125 - protein, 206 aa, Scytalidium lignicola
TVESNWGGAILIGSDFDTVSATANVPSASGGSSAAGTAWVGIDGDTCQTAILQTGFDWYGDGTYDAWYEWYPEVSDDFSGITISEGDSIQMSVTATSDTSGSATLENLTTGQKVSKSFSNESSGSLCRTNAEFIIEDFEECNSNGSDCEFVPFASFSPAVEFTDCSVTSDGESVSLDDAQITQVIINNQDVTDCSVSGTTVSCSYV

SEQ ID NO: 126 - protein, 204 aa, Scytalidium lignicola
TVESNWGGAILIGSDFDTVSATANVPSATGASGGSSAAWVGIDGDTCQTAILQTGFDWYGDGTYDAWYEWYPEVSDDFSGITISEGDSIQMSVTATSDTSGSATLENLTTGQKVSKSFSNESSGLCRTNAEFIIEDFEECNSDGSDEFVPFASFSPAVEFTDCSVTSDGESVSLDDAQITQVIINNQDVTDCSVSGTTVSCSYV

SEQ ID NO: 127 - protein, 245 aa, Thielavia terrestris
MKNAILIAAAVGLAAALPQPGAPLTRRGGTRPPHHSAPRRNTTYPEYSSNWAGAVQIGTGFTFVTGTITVPSVYNGNPYSAASAWVGIDGDTCQTAILQTGVSFYGDGSYDAWYEWIPDYSYSFSGFGLRAGDEIRMTVDATSKTTGVATLENLSTGAKVSHTFRNTPSTLCETNAEWIVEDFESGGSLVPFADFGTVTFTDAYATGSGGQVTPQGATIIDIRQSGRVLTNCGTSGADLTCTYTG

SEQ ID NO: 128 - protein, 270 aa, Penicillium chrysogenum
MKFSTTILSAALLTASAIAAPLTERRAARHAARAADRAGRISRPAAKQDTLELVSLNGTSHAQYSSNWAGAVLIGTGYTSVTGEFTVPKPNLPSDASSGQQSCASAWVGIDGDTCSSAILQTGIDFCIQGGEVSYDAWYEWYPDYAHDFSGIDISTGDVIKLTVTATSKSSGSAVIDNVTTGKSVTHKFSGVDDGDLCETNAEWIVEDFESGGQLVPFTNFGTVTFTKAEATSGGKSVGPSGATLFEIRQSKKVLTKSSVTGNSVTVSYV

SEQ ID NO: 129 - protein, 236 aa, Trichoderma reesei
MDAIRARSAARRSNRFQAGSSKNVNGTADVESTNWAGAAITTSGVTEVSGTFTVPRPSVPAGGSSREEYCGAAWVGIDGYSDADLIQTGVLWCVEDGEYLYEAWYEYLPAALVEYSGISVTAGSVVTVTATKTGTNSGVTTLTSGGKTVSHTFSRQNSPLPGTSAEWIVEDFTSGSSLVPFADFGSVTFTGATAVVNGATVTAGGDSPVIIDLEDSRGDILTSTTVSGSTVTVEYE

SEQ ID NO: 130 - protein, 265 aa, Trichoderma atroviride
MKSLTLAANLLLVASAAMATPLAARKQAAMDALRARNAARRSNKFQASSSTHVNSTADVESTNWAGAALTTSGITEVTGTFTVPKPTVPSGGSSSTEYCGAAWVGIDGYSDADLIQTGVLWCVQSGEYLYEAWYEYLPASLIAYSGITVTAGSVVTVTATKTGNNSGTTTLTSGGKTVSHTFSNQNSPLPGTSAEWIVEDFTSGSSLVPFADFGSVTFTGSSALVNGQTVTPGSGSSTIIDLENSRGQIITSTSISGGSVTVNYE

SEQ ID NO: 131 - protein, 237 aa, Trichoderma virens
MDAIRARNAVRRSNRFLAGSNSNNVNGTADVESHNWAGAALTTSGVTEVSGTFTVPKPSIPAGGSSRTEYCGAAWVGIDGYSNADLIQTGVLWCVEGGQFLYEAWYEYLPASLVAYSGISVTAGSVVTVTATKTGTNSGVTTLTSGGKTVSHTFSRESSSLPGTSAEWIVEDFTSGSSLVPFANFGSVTFTGASAVVNGATVTPGSGSAVIIDLEDASGDIITSTSVSGSSLTVNYE

SEQ ID NO: 132 - protein, 259 aa, Bombyx mori
MKFTSLTANLLLVATTALASPLSARKQAAMDALRARRSFRRSNNTAGTADATSPNWAGVAISQTGVTEVSGTFTVPQPKLPAGGDPSVSYCGVAWVGIDGWTNGDLIQTGVLWCITEGETFWDPWYEYLPGAITIYEGVTVSAGSVVTVTATKTGTNSGVTTLTVDGITVSHTFTGENFSLPGTSAEWIVEDYEYSVAGPPFVPFADFGSVTFTGATAVVNGATITPGEGNWVIIDLERSNSSITSSSFSGSTVTINYL

SEQ ID NO: 133 - protein, 271 aa, Aspergillus flavus; identical to SEQ ID NO: 121

SEQ ID NO: 134 - protein, 265 aa, Aspergillus niger; identical to SEQ ID NO: 122

SEQ ID NO: 135 - protein, 270 aa, Aspergillus nidulans
MKLSIAAISSILLAGGALAAPLTEARRQARALRGRGPSNRASHPPYKVGSTELLSLSNETQVEYSSNWAGAVLIGTGYTSVTGEFTVPTPSLPTGASRNKQYCASAWVGIDGDTCSTAILQTGIDFCIQGSSVSFDAWYEWYPDYAYDFSGITISAGDSIRVTVDATTLTAGTATVENLTTGKTVTHTFTGGVDGDLCEYNAEWIVEDFESNGQLVPFADFGTVTFTSAEVTNDGKTVGPSGATIIDIKQGNSVLTDVSVTDDSVTVSYV

SEQ ID NO: 136 - protein, 269 aa, Aspergillus clavatus
MKFSAVVASSLLAGAAIAAPLTEQRQARHARRTARATNRSSHPPYKVGSSELLELSNSTHVEYSSNWAGAVLIGNGYTSVVGEFTVPEPSAPDGADSGTQYCASAWVGIDGDTCSSAILQTGVDFCIQDGSVSFDAWYEWYPDYAYDFSGIDISVGDTIKLTIDATSKTAGSAIIQNLSTGKTVKHTFTGGVDGDLCETNAEWIVEDFESNGSLVPFVNFGTVTFTGAKATTGGSSVGPSGATLMDIKQGSSVLTSSSVSGNSVSVSYV

SEQ ID NO: 137 - protein, 269 aa, Aspergillus fumigatus
MKFTSVLASGLLATAAIAAPLTEQRQARHARRLARTANRSSHPPYKPGTSEVIKLSNTTQVEYSSNWAGAVLIGTGYTAVTGEFVVPTPSVPSGGSSSKQYCASAWVGIDGDTCSSAILQTGVDFCIQGSSVSFDAWYEWYPDYAYDFSGISISAGDTIRVTVDATSKTAGTATVENVTKGKTVTHTFTGGVDGNLCEYNAEWIVEDFESNGSLVPFANFGTVTFTGAQATDGGSTVGPSGATLIDIQQSGKVLTSVSTSSSSVTVKYV

SEQ ID NO: 138 - protein, 262 aa, Penicillium marneffei
MKSSVLSTLLLAGLAVAAPSTQKGLARRAARRSNPAYLPNSFGVEQLNITGTKHVEYSSNWSGAVLIGTGYSAVTAEFTVPTPHIPSGGSSGTQYCASAWVGLDGDTCGTSILQTGVDFCVQGSSVSYDAWYEWYPDYAYDFTGISISAGDLIKITVTATSTSSGSAVVQNVSKGTTVTHNFSGESDKLCEYNAEWIVEDFEEGGSLVPFANFGTVTFSGAKATKSGSSVDTTGATIIDIEQNSSVLTSVTASGSTVTVKYV

SEQ ID NO: 139 - protein, 274 aa, Talaromyces stipitatus
MKSIVLSLLILAGLTAAAPLTEKRLARRAAGTRRSSPPYVPNSYGVEQLNITNSKNVEYSENWAGAVLIGTGYTAVTAEFTVPTPTAPGGGNTEYCASAWVGLDGDTCDSSILQTGVDFCVQGGDVSYDAWYEWYPDYAYDFSGISISAGDVMKITVTATSTSSGSAVVENVSTGRTVTHSFSGESDRLCEYNAEWIVEDFEEGDSLVPFANFGTVTFTNAVATHNGAGVGTSGATIIDIEQDSGVLTSVSASGNTVTVNMKHTNTDIHDDGGG

SEQ ID NO: 140 - protein, 274 aa, Grosmannia clavigera
MKLLNVAGALLFANAALGARFTERRRARLAQRAPGSVSRTGFGQPLIAADGLDIDEDAATNGTADVDYSSNWSGAVLISTGYKSVTGTFVVPTPKAPTGGSSSTQYAASAWVGIDGDTASNSILQTGIDFYIEDGEASYDAWYEWYPDYAYTFSGFSISAGDTITVTVTASSTSSGKAVIKNASTGKSVTHSFSSESNTLEELNAEWIVEDFEEDGGLVPFANFGTVTFTDATAIGSDGTVGPDGATLIDIRQSGKVLTSASLSGGDVVVSYVG

SEQ ID NO: 141 - protein, 269 aa, Neosartorya fischeri
MKFTSVLTSGLLATATIAAPLTEQRQARHARRMARNSNRSSHPPYKPGTSEVIKLSNTTQVEYSSNWAGAVLIGSGYTAVTGEFVVPTPHAPSGGSSNEQYCASAWVGIDGDTCSSAILQTGVDFCIQGGSVSFDAWYEWYPDYAYDFSGISISAGDTIRVTVDATSKTAGTATVENVTKGKTVTHTFTGGVDGNLCEYNAEWIVEDFESNGSLVPFANFGTVTFTGAQATDGGSTVGPSGATLMDIEQNGQVLTSVSSSSSSVTVKYV

SEQ ID NO: 142 - protein, 270 aa, Penicillium marneffei
MIFSIKTLVPLLLAGTAIASPATIPAARRFRGGSDASFANFTSSADEASAATLGTYTFTNWAGAFLRNTAVTSVTGTFVIPKPSMPAGGNSGTSYCGCAWVGLDGISNFCPNGGLIQAGVNWCVENGVTSFAAWHEWWPAEAMQYWDNVSVSAGDSITVTITASNTEAGSATLINNTTGQRVRFVWTYKTPSLCEATAEWIVEDYSIGNNLVAFADYGSVTFTGNSAVIHGATTSDLSNSYIANMVSVSNPSQVISASTVNGNAITVVYQ

SEQ ID NO: 143 - protein, 270 aa, Penicillium chrysogenum; identical to SEQ ID NO: 128

SEQ ID NO: 144 - protein, 282 aa, Aspergillus niger
MKFSTILTGSLFATAALAAPLTEKRRARKEARAAGKRHSNPPYIPGSDKEILKLNGTTNEEYSSNWAGAVLIGDGYTKVTGEFTVPSVSAGSSGSSGYGGGYGYWKNKRQSEEYCASAWVGIDGDTCETAILQTGVDFCYEDGQTSYDAWYEWYPDYAYDFSDITISEGDSIKVTVEATSKSSGSATVENLTTGQSVTHTFSGNVEGDLCETNAEWIVEDFESGDSLVAFADFGSVTFTNAEATSGGSTVGPSDATVMDIEQDGSVLTETSVSGDSVTVTYV

SEQ ID NO: 145 - protein, 612 aa, Trichoderma reesei
MAKLSTLRLASLLSLVSVQVSASVHLLESLEKLPHGWKAAETPSPSSQIVLQVALTQQNIDQLESRLAAVSTPTSSTYGKYLDVDEINSIFAPSDASSSAVESWLQSHGVTSYTKQGSSIWFQTNISTANAMLSTNFHTYSDLTGAKKVRTLKYSIPESLIGHVDLISPTTYFGTTKAMRKLKSSGVSPAADALAARQEPSSCKGTLVFEGETFNVFQPDCLRTEYSVDGYTPSVKSGSRIGFGSFLNESASFADQALFEKHFNIPSQNFSVVLINGGTDLPQPPSDANDGEANLDAQTILTIAHPLPITEFITAGSPPYFPDPVEPAGTPNENEPYLQYYEFLLSKSNAEIPQVITNSYGDEEQTVPRSYAVRVCNLIGLLGLRGISVLHSSGDEGVGASCVATNSTTPQFNPIFPATCPYVTSVGGTVSFNPEVAWAGSSGGFSYYFSRPWYQQEAVGTYLEKYVSAETKKYYGPYVDFSGRGFPDVAAHSVSPDYPVFQGGELTPSGGTSAASPVVAAIVALLNDARLREGKPTLGFLNPLIYLHASKGFTDITSGQSEGCNGNNTQTGSPLPGAGFIAGAHWNATKGWDPTTGFGVPNLKKLLALVRF

SEQ ID NO: 146 - protein, 609 aa, Trichoderma atroviride
MAKLTALAGLLTLASVQANAAVLLDSLDKVPVGWQAASAPAPSSKITLQVALTQQNIDQLESKLAAVSTPNSSNYGKYLDVDEINQIFAPSSASTAAVESWLKSYGVDYKVQGSSIWFQTDVSTANKMLSTNFHTYTDSVGAKKVRTLQYSVPETLADHIDLISPTTYFGTSKAMRALKIQNAASAVSPLAARQEPSSCKGTIEFENRTFNVFQPDCLRTEYSVNGYKPSAKSGSRIGFGSFLNQSASSSDLALFEKHFGFASQGFSVELINGGSNPQPPTDANDGEANLDAQNIVSFVQPLPITEFIAGGTAPYFPDPVEPAGTPDENEPYLEYYEYLLSKSNKELPQVITNSYGDEEQTVPQAYAVRVCNLIGLMGLRGISILESSGDEGVGASCLATNSTTTPQFNPIFPATCPYVTSVGGTVSFNPEVAWDGSSGGFSYYFSRPWYQEAAVGTYLNKYVSEETKEYYKSYVDFSGRGFPDVAAHSVSPDYPVFQGGELTPSGGTSAASPIVASVIALLNDARLRAGKPALGFLNPLIYGYAYKGFTDITSGQAVGCNGNNTQTGGPLPGAGVIPGAFWNATKGWDPTTGFGVPNFKKLLELVRYI

SEQ ID NO: 147 - protein, 612 aa, Trichoderma virens
MPKSTALRLVSLLSLASVPISASVLVESLEKLPHGWKAASAPSPSSQITLQVALTQQNIDQLESRLAAVSTPNSKTYGNYLDLDEINEIFAPSDASSAAVESWLHSHGVTKYTKQGSSIWFQTEVSTANAMLSTNFHTYSDAAGVKKLRTLQYSIPESLVGHVDLISPTTYFGTSNAMRALRSKSVASVAQSVAARQEPSSCKGTLVFEGRTFNVFQPDCLRTEYNVNGYTPSAKSGSRIGFGSFLNQSASFSDLALFEKHFGFSSQNFSVVLINGGTDLPQPPSDDNDGEANLDVQNILTIAHPLPITEFITAGSPPYFPDPVEPAGTPDENEPYLQYFEYLLSKPNRDLPQVITNSYGDEEQTVPQAYAVRVCNLIGLMGLRGISILESSGDEGVGASCVATNSTTPQFNPIFPATCPYVTSVGGTVNFNPEVAWDGSSGGFSYYFSRPWYQEEAVGNYLEKHVSAETKKYYGPYVDFSGRGFPDVAAHSVSPDYPVFQGGQLTPSGGTSAASPVVASIIALLNDARLREGKPTLGFLNPLIYQYAYKGFTDITSGQSDGCNGNNTQTDAPLPGAGVVLGAHWNATKGWDPTTGFGVPNFKKLLELIRYI

SEQ ID NO: 148 - protein, 594 aa, Aspergillus fumigatus
MLSSTLYAGWLLSLAAPALCVVQEKLSAVPSGWTLIEDASESDTITLSIALARQNLDQLESKLTTLATPGNPEYGKWLDQSDIESLFPTASDDAVLQWLKAAGITQVSRQGSLVNFATTVGTANKLFDTKFSYYRNGASQKLRTTQYSIPDHLTESIDLIAPTVFFGKEQNSALSSHAVKLPALPRRAATNSSCANLITPDCLVEMYNLGDYKPDASSGSRVGFGSFLNESANYADLAAYEQLFNIPPQNFSVELINRGVNDQNWATASLGEANLDVELIVAVSHPLPVVEFITGGSPPFVPNADEPTAADNQNEPYLQYYEYLLSKPNSHLPQVISNSYGDDEQTVPEYYARRVCNLIGLMGLRGITVLESSGDTGIGSACMSNDGTNKPQFTPTFPGTCPFITAVGGTQSYAPEVAWDGSSGGFSNYFSRPWYQSFAVDNYLNNHITKDTKKYYSQYTNFKGRGFPDVSAHSLTPYYEVVLTGKHYKSGGTSAASPVFAGIVGLLNDARLRAGKSTLGFLNPLLYSILAEGFTDITAGSSIGCNGINPQTGKPVPGGGIIPYAHWNATAGWDPVTGLGVPDFMKLKELVLSL

SEQ ID NO: 149 - protein, 594 aa, Aspergillus oryzae
MRSSFLLAGVFGSLAAPALAIVHEKVAAVPNGWTLVKQAPESDPITLSIALARQNLDQLESKLTALSTPGNAEYGQWLDQSGIETLFPTASDEAVLRWLRNAGVTHISRQGGLVNFATSVGTVNKLFDTKFSYYKNGQVQKLRTTQYSIPDDLADGIDLVAPTVFFGKQQESVALPTHHKFAAGTKTAAGNVSCADIITPDCLADMYNFRGYKPSASSGSKVGFGSFLNESANYVDLALYEKRFNIPSQNFSVELINGATNDQNWTTASLGEANLDVELIVGVSHPLPVKEYITAGTPPFIPNALQPTPADNQNEPYLEYYEYLLAKPNSALPQVLSNSYGDEEQTVPEYYAKRVCNLIGLMGLRGITVLESSGDTGIGASCMSNDGTETPEFTPIFPATCPYLTSVGGTQAYAPEVAWDASSGGFSNYFSRAWYQESAVSKYLDQQITAETKDYYSQYTNFSGRGFPDVAAHSLTPRYEVVVKGKRATSGGTSAAAPVFAGLVGMLNDARLRAGKPTLGFLNPLLYSGALKDFTDITAGSSIGCDGVNPQTGKNVTGGGVIPYAHWNATAGWDPVTGLGVPDFMKLKDLVLSL

SEQ ID NO: 150 - protein, 595 aa, Aspergillus niger
MRSSGLYTALLCSLAASTNAIVHEKLAAVPSGWHHVEDAGSDHQISLSIALARKNLDQLESKLKDLSTPGESQYGQWLDQEDVDTLFPVASDKAVINWLRSANITHISRQGSLVNFATTVDKVNKLLNATFAYYQSGSSQRLRTTEYSIPDDLVDSIDLISPTTFFGKEKTTAGLNQRAQKIDTHVAKRSNSSSCADVITLSCLKEMYNFGNYTPSASSGSKLGFGSFLNESASYSDLAKFEKLFNLPSQSFSVELVNGGVNDQNQSTASLTEADLDVELLVGVAHPLPVTEFITSGEPPFIPDPDEPSAADNENEPYLQYYEYLLSKPNSALPQVISNSYGDDEQTVPEYYAKRVCNLIGLVGLRGISVLESSGDEGIGSGCRTTDGTNRTQFNPIFPATCPYVTAVGGTMSYAPEIAWEASSGGFSNYFERAWFQKEAVQNYLAHHITNETKQYYSQFANFSGRGFPDVAAHSFEPSYEVIFYGARYGSGGTSAACPLFSALVGMLNDARLRAGKSTLGFLNPLLYSKGYRALTDVTGGQSIGCNGIDPQNDETVAGAGIIPWAHWNATVGWDPVTGLGLPDFEKLRQLVLSL

SEQ ID NO: 151 - protein, 594 aa, Aspergillus clavatus
MLSSTLYAGLLCSLAAPAFGIAHEKLAAVPNGWTLIKDAPETDTITLSIALARQNLDQLESKLTTLATPGNAEYGQWLDKADIESLFPTASDEAIIEWLKAAGITQVSRQGSLVNFASTVGTVNKLFNTTFSYYQNGASQKLRTTEYSIPDSLTDAIDLVAPTVFFGKDQDNALPSFASKLPTLPKRASNSSSCADLITPACLAEMYNLGDYKPVVSSGSRIGFGSFLNESANYADLAAYEKLFKIPSQNFSVELINGGTNDQNWNTAQLGEADLDVELIVAVSHPLPVVEYITGGSPPYVPNADGPTAADNQNEPYLEYYEYLLSKPNAALPQVISNSYGDDEQTVPKYYAKRVCNMIGLMGLRGITVLESSGDTGIGSACMSNDGTNTPQFTPTFPGTCPFITSVGGTQAYAPEVAWDGSSGGFSNYFKRPRYQEAAVKSYLKHHISKDTKEYYSQYTNFHGRGFPDVSAHSLTPDYEVINYGARSRSGGTSAACPVFAGIVGMLNDARLRAGKPTLGFLNPLLYSEGFKTFTDITAGASVGCDGTNPQSGKPVPGGGIIPYAHWNATAGWDPVTGLGVPNFLKLKELVLSF

SEQ ID NO: 152 - protein, 580 aa, Aspergillus niger
MVAFSRISAGFALAAPALASVVLETVKSVPSDWKLVEAADTSSTISLSVALARQNLDQLEEKLLAVSTPGKDTYGQFLDLDDINEQFPLADDAAVVAWLKKAGVTQIHKEGGLLNFATTVGTANQLLNTTFSVYKSGSTQKLRTTQYSVPDELTGSIDLISPTVFFGKSNAARSAAVRASQTTKETSRKKSSNVCEYITPDCLKEQYSIDYTPEASSGSRVGFGSFLNESALYSDLDLFTQYFDIPQQSFTVETINGGINNQENDPDGEADLDVQNIVGISHPLPVTEYITGGSPPFIPDVETTTDENEPYLQYYEYLLAKTNDELPLVISNSYGDDEDTVPIAYATRVCNLIGLMGTRGISILESSGDSGVGGACMSNDGTDKTEFTPMFPGTCPYITAVGGTQDVPEVAWVDSSGGFSNYFSQPSYQSDQVETYLDKYISASTKKYYEQYTNFSGRAFPDVSAFAGSPYYETYIDGQLGLVAGTSGASPVFAGIVALLNDARLRANKTSLGFLNPWLYSSGYKSLNDITSGEAVGCQGDVEGAGVIPWASWNATTGWDPATGLGTPNFAKLKEAVLAL

SEQ ID NO: 153 - protein, 602 aa, Aspergillus clavatus
MFSSLFSRGALSLAVVSLLTSSVAAEVFEKLSTVPQGWKYSHAPSDSDPIRLQIALQQQDVDGFEKALLEMSDPSHASYGKHFQSHEEMKRMLLPSQESVQSVRSWLESGGVTDIEEDADWINFRTTVGVANTLLDADFKWYVSDVRSLERLRTLSYSIPESLASHVHMIQPTTRFGQIKANRATLHSSSLYRDEKILSASLQAGNSTCDQVITPQCLKSLYNIGDYKADARSGSKVAFASFLEEYARYDDLAKFEEKLAPYAIGQNFSVIQYNGGLNDQNSTSDSGEANLDLQYMLGISAPLPITEFSTGGRGKLIPDLSSPDPNDNSNEPYLEFLQNVLKMPQHKLPQVISTSYGEDEQTIPKRYALSVCNLYAQLGSRGVSVIFSSGDSGVGAACQTNDGHNTTHFPPQFPAACPWVTSVGGTTNTQPEEAVYFSSGGFSDLWPRPGYQEVAVRGYLKKLGGTYRGLYNPRGRAFPDVAAQAMKYAVFDKGALHQYAGTSCSAPAFGGIIGLLNDARLRAHKPPMGFLNPWLYSQASHGFNDIVVGGSKGCDGRNRFGGTPNGSPVVPYASWNATEGWDPATGLGTPNFGKLLHLALRR

SEQ ID NO: 154 - protein, 600 aa, Aspergillus terreus
MLPSLVNNGALSLAVLSLLTSSVAGEVFEKLSAVPKGWHFSHAAQADAPINLKIALKQHDVEGFEQALLDMSTPGHENYGKHFHEHDEMKRMLLPSDSAVDAVQTWLTSAGITDYDLDADWINLRTTVEHANALLDTQFGWYENEVRHITRLRTLQYSIPETVAAHINMVQPTTRFGQIRPDRATFHAHHTSDARILSALAAASNSTSCDSVITPKCLKDLYKVGDYEADPDSGSQVAFASYLEEYARYADMVKFQNSLAPYAKGQNFSVVLYNGGVNDQSSSADSGEANLDLQTIMGLSAPLPITEYITGGRGKLIPDLSQPNPNDNSNEPYLEFLQNILKLDQDELPQVISTSYGEDEQTIPRGYAESVCNMLAQLGSRGVSVVFSSGDSGVGAACQTNDGRNQTHFNPQFPASCPWVTSVGATTKTNPEQAVYFSSGGFSDFWKRPKYQDEAVAAYLDTLGDKFAGLFNKGGRAFPDVAAQGMNYAIYDKGTLGRLDGTSCSAPAFSAIISLLNDARLREGKPTMGFLNPWLYGEGREALNDVVVGGSKGCDGRDRFGGKPNGSPVVPFASWNATQGWDPVTGLGTPNFAKMLELAP

SEQ ID NO: 155 - protein, 602 aa, Aspergillus fumigatus
MFSSLLNRGALLAVVSLLSSSVAAEVFEKLSAVPQGWKYSHTPSDRDPIRLQIALKQHDVEGFETALLEMSDPYHPNYGKHFQTHEEMKRMLLPTQEAVESVRGWLESAGISDIEEDADWIKFRTTVGVANDLLDADFKWYVNEVGHVERLRTLAYSLPQSVASHVNMVQPTTRFGQIKPNRATMRGRPVQVDADILSAAVQAGDTSTCDQVITPQCLKDLYNIGDYKADPNGGSKVAFASFLEEYARYDDLAKFEEKLAPYAIGQNFSVIQYNGGLNDQNSASDSGEANLDLQYIVGVSSPIPVTEFSTGGRGLLIPDLSQPDPNDNSNEPYLEFLQNVLKMDQDKLPQVISTSYGEDEQTIPEKYARSVCNLYAQLGSRGVSVIFSSGDSGVGAACLTNDGTNRTHFPPQFPAACPWVTSVGGTTKTQPEEAVYFSSGGFSDLWERPSWQDSAVKRYLKKLGPRYKGLYNPKGRAFPDVAAQAENYAVFDKGVLHQFDGTSCSAPAFSAIVALLNDARLRAHKPVMGFLNPWLYSKASKGFNDIVKGGSKGCDGRNRFGGTPNGSPVVPYASWNATDGWDPATGLGTPDFGKLLSLAMRR

SEQ ID NO: 156 - protein, 595 aa, Sclerotinia sclerotiorum
MMYPKTAICAGLLSQALPAYGAVMEKLAAVPSGWTVAETDSSTAITLTVGLAMQNLDQLEAKLIAVSTPGNADYGNHLDADEANALFAPSADASNAVTSWLTSAGAQNIVSDGSTVTFAATIEKANSILNATFQTYTSNGVTKVRTTQYSVPDHLAEHIDLISPTTYFGKTVANAPTKVTKKDTSATKVTVDASCSTSITPKCIKELYNVGDYTPSVSSGSRIGFGSFLNQSALYSDLFQYEKYFDIPQQNFSVTLINGATNDQNPATAQNGEANLDVQNIIGVAHPLPVQEFITGGSPPFVPNIDVPTAADNSNEPYLPYYQYLMTQPNSAIPQVISNSYGDDEDTVPYAYAVRVCNLIGIMGLRGISILESSGDTGVGAGCVANDGKDTPYFQPQFPGTCPYITSVGGTQSVSPEVAWDDGSGGFSNYFPTAWYQTAAVAEYLTEHITPSTRKYYESYTNFSGRGFPDISAHSLTPDYQVVYSGELSPSGGTSAAAPVVAAILGLLNDARFKAGKSALGFVNPLLYLLGTSALNDITGGGSVGCNGVNGQTGAKIPNGAVIPYATWNATKGWDPVTGLGTPDFEKLKELVLSY

SEQ ID NO: 157 - protein, 595 aa, Botryotinia fuckeliana
MYPKTAICAGLLSQALPAYGAVMEKLAAAPSGWTAASETDSSAAITLTVGLAMQNLDQLEAKLLAVSTPGNAEYGNHLDIDEANALFAPSADASSAVTSWLTSAGAQNIVSDGSTISFATTIEKANSMLNAKFKSYTSNGVTKVRTTQYSVPDDVAEHIELISPTTYFGKTVANAPTKIAKRDTSATKVTVDAACSTSITPKCIKELYNIGDYTPSVSSGSRIGFGSFLNQSALYTDLFQYESYFGIPEQNFTVTLINGATNDQNEATAQIGEANLDVQNIIGVAHPLPVQEFITGGSPPFIPNVDLPTEADNSNEPYLPYYEYLLSQPNSALPQVISNSYGDDEDTVPYAYAVRVCNLIGIMGLRGISVLESSGDTGVGAGCVANDGLNTPYFQPQFPGTCPYITSVGGTQAVAPEVAWDDGSGGFSNYFPTAWYQVAAVDEYLNKHISPSTKEYYESYTNFSGRGFPDISAHSLTPDYQVVYFGELSPSGGTSAAAPVIAGILGLLNDARFKAGKPALGFINPLLYLLGQGALNDITGGASVGCNGVNGQTGAKVPGGAVIPYASWNATKGWDPVTGLGTPNFEKLKALVLSY

SEQ ID NO: 158 - protein, 594 aa, Neosartorya fischeri
MLSSTLYAGLLCSLAAPALGVVHEKLSAVPSGWTLVEDASESDTTTLSIALARQNLDQLESKLTTLATPGNAEYGKWLDQSDIESLFPTASDDAVIQWLKDAGVTQVSRQGSLVNFATTVGTANKLFDTKFSYYRNGASQKLRTTQYSIPDSLTESIDLIAPTVFFGKEQDSALPPHAVKLPALPRRAATNSSCANLITPDCLVEMYNLGDYKPDASSGSRVGFGSFLNQSANYADLAAYEQLFNIPPQNFSVELINGGANDQNWATASLGEANLDVELIVAVSHALPVVEFITGGSPPFVPNVDEPTAADNQNEPYLQYYEYLLSKPNSHLPQVISNSYGDDEQTVPEYYARRVCNLIGLMGLRGITVLESSGDTGIGSACMSNDGTNTPQFTPTFPGTCPFITAVGGTQSYAPEVAWDASSGGFSNYFSRPWYQYFAVENYLNNHITKDTKKYYSQYTNFKGRGFPDVSAHSLTPDYEVVLTGKHYKSGGTSAACPVFAGIVGLLNDARLRAGKSTLGFLNPLLYSILAEGFTDITAGSSIGCNGINPQTGKPVPGGGIIPYAHWNATAGWDPVTGLGVPDFMKLKELVLSL

SEQ ID NO: 159 - protein, 605 aa, Talaromyces stipitatus
MSRNLLVGAGLLALAQLSGQALAAAALVGHESLAALPVGWDKVSTPAAGTNIQLSVALALQNIEQLEDHLKSVSTPGSASYGQYLDSDGIAAQYGPSDASVEAVTNWLKEAGVTDIYNNGQSIHFATSVSKANSLLGADFNYYSDGSATKLRTLAYSVPSDLKEAIDLVSPTTYFGKTTASRSIQAYKNKRASTTSKSGSSSVQVSASCQTSITPACLKQMYNVGNYTPSVAHGSRVGFGSFLNQSAIFDDLFTYEKVNDIPSQNFTKVIIANASNSQDASDGNYGEANLDVQNIVGISHPLPVTEFLTGGSPPFVASLDTPTNQNEPYIPYYEYLLSQKNEDLPQVISNSYGDDEQSVPYKYAIRACNLIGLTGLRGISVLESSGDLGVGAGCRSNDGKNKTQFDPIFPATCPYVTSVGGTQSVTPEIAWVASSGGFSNYFPRTWYQEPAIQTYLGLLDDETKTYYSQYTNFEGRGFPDVSAHSLTPDYQVVGGGYLQPSGGTSAASPVFAGIIALLNDARLAAGKPTLGFLNPFFYLYGYKGLNDITGGQSVGCNGINGQTGAPVPGGGIVPGAAWNSTTGWDPATGLGTPDFQKLKELVLSF

SEQ ID NO: 160 - protein, 604 aa, Penicillium marneffei
MSRNLLVGAGLLALAQLNPVLAASALVSHEALATLPPGWDKVNTPAGHTNIQLSVALTLQNIEQLQSHLQSVSTPGSSGYGQYLDSDDIAAQYGPSDASVDAVTKWLKEAGITEIHNNGQSINFATTVSKANKLLGADFHYYSDGGATKLRTLAYSVPSDLQAAIDLVSPTTYFGKTTASRSIQTYSNKRASTTTKSGSSSVAVAASCQTSITPACLKQMYNVGNYTPSVASGSRVGFGSFLNQSAIYDDLFTYEKVNGIPNQNWTKVIIANAPNDQDPNDGNYGEANLDVQNIVGISHPLPVTEFLTGGSPPFVPSLDTPTNENEPYIPYYEYLLSQKNADLPQVISNSYGDDEQSVPYKYAVRACNLIGLTGLRGITVLESSGDLGVGAGCLSNDGKNKTQFDAIFPATCPYITAVGGTQAVTPEIAWTASSGGFSYYFPRPWYQRKAIETYLGLLDDSTKQYYSQYTNFEGRGFPDVAAHSLLPDYQVVGGGELQRSGGTSAASPVFAGIIALLNDARLSAGKPTLGFLNPFIYYAGYKGLNDITGGKSIGCNGVNGQTGGTVPGGGVVPGAAWNCTTGWDPATGLGTPDFQKLKELVLSF

SEQ ID NO: 161 - protein, 600 aa, Gibberella zeae
MYITSSRLVLALAALPTAFGKSYSHHAEAPKGWKVDDTARVASTGKQQVFSIALTMQNVDQLESKLLDLSSPDSKNYGQWMSQKDVTTAFYPSKEAVSSVTKWLKSKGVKHYNVNGGFIDFALDVKGANALLDSDYQYYTKEGQTKLRTLSYSIPDDVAEHVQFVDPSTNFGGTLAFAPVTHPSRTLTERKNKPTKSTVDASCQTSITPSCLKQMYNIGDYTPKVESGSTIGFSSFLGESAIYSDVFLFEEKFGIPTQNFTTVLINNGTDDQNTAHKNFGEADLDAENIVGIAHPLPFTQYITGGSPPFLPNIDQPTAADNQNEPYVPFFRYLLSQKEVPAVVSTSYGDEEDSVPREYATMTCNLIGLLGLRGISVIFSSGDIGVGAGCLGPDHKTVEFNAIFPATCPYLTSVGGTVDVTPEIAWEGSSGGFSKYFPRPSYQDKAVKTYMKTVSKQTKKYYGPYTNWEGRGFPDVAGHSVSPNYEVIYAGKQSASGGTSAAAPVWAAIVGLLNDARFRAGKPSLGWLNPLVYKYGPKVLTDITGGYAIGCDGNNTQSGKPEPAGSGIVPGARWNATAGWDPVTGYGTPDFGKLKDLVLSF

SEQ ID NO: 162 - protein, 599 aa, Fusarium oxysporum
MYISSQNLVLALSALPSAFGKSFSHHAEAPQGWQVQKAAKVASNTQHVFSLALTMQNVDQLESKLLDLSSPDSANYGNWLSHDELTSTFSPSKEAVASVTKWLKSKGIKHYKVNGAFIDFAADVEKANTLLGGDYQYYTKDGQTKLRTLSYSIPDDVAGHVQFVDPSTNFGGTVAFNPVPHPSRTLQERKVSPSKSTVDASCQTSITPSCLKQMYNVGDYTPDAKSGSEIGFSSFLGQAAIYSDVFKFEELFGIPKQNYTTILINNGTDDQNTAHKNYGEANLDAENIVGIAHPLPFKQYITGGSPPFVPNIDQPTEKDNQNEPYVPFFRYLLGQKDLPAVISTSYGDEEDSVPREYATLTCNMIGLLGLRGISVIFSSGDIGVGSGCLAPDYKTVEFNAIFPATCPYLTSVGGTVDVTPEIAWEGSSGGFSKYFPRPSYQDKAIKKYMKTVSKETKKYYGPYTNWEGRGFPDVAGHSVAPDYEVIYNGKQARSGGTSAAAPVWAAIVGLLNDARFKAGKKSLGWLNPLIYKHGPKVLTDITGGYAIGCDGNNTQSGQPEPAGSGLVPGARWNATAGWDPTTGYGTPNFQKLKDLVLSF

SEQ ID NO: 163 - protein, 637 aa, Grosmannia clavigera
MATEHHARTRAAVVLHTLRGSMATLALAVSSLLLLPAAEAAVISSIDTVPKGWSVAPAAKINARTSSAQVFTIALALQNIDQLESHLLSVSSPNSASYGAHEDVEGITAKYGPSDEAVQVVTAWLKSSSAVQTFSVRDGFVDVAATVDGANTLFNASYDFYTHEANAATTKLRTLSYSVPDHVAAHVALVDPGNYFGKTAAFAPRRGAPAPVPASKTARSPSLVKARGTSTTIDAACSTSITPACLKQLYNVGNYTPDASSGSRVGFGSFLNQSALYADVFTYEERNGIAAQNFTVELIANATNDQDKWTASVDEANLDVQNIIGVSHPLPVIEYITGGSPPFVADIDLPSAAENQNEPYLPYLSYLLAKSNSELPQAISNSYGDEEDSVPYNYANYTCNLIGMLGLRGITVLHSSGDMGVGAGCLAPDNTTVEFNPIYPATCPYVTAVGGTVNVSPEIAWKGSSGGFSKYFPRPSYQDKAVSEYLSDHVNASTVKYYAPYTNFSGRGFPDVSAHSVSPAYEIIYFDQPGPSGGTSAAAPVWAGIVGLLNDARLRSGKSTLGWLNPLIYTYGPSVLNDITDGYSVGCNGVNYQTDQYEPAGAGIVPGAHWNATVGWDPVTGYGTPNFEELKKVVLGL

SEQ ID NO: 164 - protein, 594 aa, Verticillium albo-atrum
MVLPKLHACVSRAATLPASIQLIRQAPAGDEIQLQIALKHQNIHKLESTLRSVSDPSSSHYGQYLSKDEVNALFAPSNHSRTAVESWLKDAGITAVSTRGPLVDFVTTVAKANELLGADFAWFDVEGHKKLRTTEYSIPDTLTAHIDLVAPTTFFGRTKSHRMIPDDETSELDARQARNTTTCLSVITPDCLEEAYNYGSYKADPAAGSRVAFASFLNQSARQEDLTQYLNTFKLPPRNFTTVLINGGEDHQDPNGDIGEANLDAQFLAAVTKNLPLKQFITGGSPPFVPNLRITNASTNSNEPYLDFYETLLATDDEGVPQVLSSSYGDDEQTVPVEYAKRVCNLIGMMGLRGVTVLESSGDAGVGAPCRANDGSGRAEFTPTFPGTCPYLTAVGGTQAWAPEVAWVGSAGGFSNYFERAWYQKAAVKTYLKESIPAEVKSYYKHGGFVDFGGRGFPDISAHSLEPWYQFVNAGRPRRTGGTSAAAPVVAGIIGLLNDARLRAGQPTMGFLNPWLYARGVDGLLDVTEGKAEGCGGIDLQSGNPVPGAGVIPWASWNATKGAATDCGQWHQGMIWCCWVPVVAMYLEMLREQG

SEQ ID NO: 165 - protein, 566 aa, Verticillium dahliae
MVLLKLHACVAATLVALTEALLVSRAATLPASIQLIRQAPAGDEIQLQIALKHQNIHKLESKLRSVSDPSSSHYGQYLSKDEVNALFAPSNHSRTAVESWLKDAGITAVSSRGPLVDFVTTVAKANELLGADFAWFDVEGHKKLRTTEYSIPDTLTAHIDLVAPTTFFGRTKSHRMIPDDETSELDSRQARNTTTCLSVITPDCLEEAYNYGSYKADPAAGSRVAFASFLNQSARQEDLTQYLNTFKLPPRNFTTVLINGGEDHQDPNGDIGEANLDAQFLAAVTKNLPLKQFITGGSPPFVPNLRITNASTNSNEPYLDFYETLLATDDEGVPQVLSSSYGDDEQTVPVEYAKRVCNLIGMMGLRGVTVLESSGDAGAWAPEVAWVGSAGGFSNYFERAWYQKAAVKTYLEESIPVEVKSYYKRGGFVDFGGRGFPDISAHSLEPWYQFVNAGRPRRTGGTSAAAPVVAGIIGLLNDARLRAGQPTMGFLNPWLYARGVDGLLDVTEGKAEGCGGIDLQSGNPVPGAGVIPWASWNATKGWDPVTGLGLPDFEALRQIAVNGTKA

SEQ ID NO: 166 - protein, 391 aa, Trichoderma reesei
MRLSVLLSVLPLVLAAPAIEKRAEPAPLLVPTTKHGLVADKYIVKFKDGSSLQAVDEAISGLVSNADHVYQHVFRGFAATLDKETLEALRNHPEVDYIEQDAVVKINAYVSQTGAPWGLGRISHKARGSTTYVYDDSAGAGTCSYVIDTGVDATHPDFEGRATLLRSFVSGQNTDGNGHGTHVSGTIGSRTYGVAKKTQIYGVKVLDNSGSGSFSTVIAGMDYVASDSQTRNCPNGSVANMSLGGGYTASVNQAAARLIQAGVFLAVAAGNDGVDARNTSPASEPTVCTVGASTSSDARASFSNYGSVVDIFAPGQDILSTWPNRQTNTISGTSMATPHIVGLGAYLAGLEGFSDPQALCARIQSLANRNLLSGIPSGTINAIAFNGNPSG

SEQ ID NO: 167 - protein, 371 aa, Trichoderma atroviride
MAAPSRRASPAPVLVPRGAQVLEGRYIVKMKTEAQVSAVESALSGVSAGASHRYSHSFSGFAASLTPGELEILQNDPNVDFIEQDATVSTKAIVTEGSADWGLSRISNKKPDTTRYSYDSSAGEGTCAFVIDTGIDVHHPEFEGRAKFLENFVGDGSDADLFGHGTHVSGIIAGKTFGVAKKASLFAVKVLDVNGQGNNSVIIAGMDYVAKNASSQHCPKGIVVNMSLGGIKTDAVNQAAISITNAGLFLAAAAGNDALDAADFSPACVPAVCTVGATDRNDTFALYSNRGSAVDILAPGTNITSSWPGNLTKVMSGTSMASPHVAGLGAYLLGLGQKIGGLCGTISSSALKGAIKGVPESTVNLLVQNGA

SEQ ID NO: 168 - protein, 391 aa, Trichoderma virens
MRLSVLLSLLPMVLAAPAIEKRAEPAPLFKPTSKHGLVADQYIVKFKEGSSLQAVDETLTRIASDAHHVYQHVFNGFAGKLDQETLEALRNHPDVEYIEQDAIVKVNAFVQQTGAPWGLGRISHKARGSTTYVYDDSAGAGTCAYIIDTGVDATHPEFEGRATFLKTYVSGQNTDGNGHGTHVAGTIGSRSYGVAKKTQLFGVKVLDNSGSGTFANVIAGMDFVASDSKTRNCPNGSVANMSLGGGVSSAVNEAAAALIAADVFLAVAAGNDGTDARNTSPASEPTVCTVGATTSADARASFSNYGSVVDIFAPGQDILSTWPSGRTNTISGTSMATPHIVGLGAYLLSLEGHIAPQALCSRIQSLAGKSLLSGIPSGTINAVAFNGNPSG

SEQ ID NO: 169 - protein, 391 aa, Hypocrea koningii
MRLSVLLSVLPLVLVAPATEKRAEPAPLLVPTTKHGLVADKYIVKFKDGSSLQAVDEAISGLVSNADHVYQHVFRGFAATLDKKTLETLRNHPEVDYIEQDAVVKINSYVSQSGAPWGLGRISHKARGSTTYVYDDSAGAGTCSYVIDTGVDAAHPDFEGRATLLRSFVSGQNTDGNGHGTHVSGTIGSRTYGVAKKTQIYGIKVLDNSGSGSFSTVIAGMDYVASDSQTRNCPNGSVANMSLGGGYTASVNQAAARLIQAGVFLAVAAGNDGVDARNTSPASEPSVCTVGASTSSDARASFSNYGSVVDIFAPGQDILSTWPNRQTNAISGTSMATPHIVGLGAYLAGLEGFSDPQALCARIQALAGRNLLSGIPSGTINAIAFNGNPSG

SEQ ID NO: 170 - protein, 390 aa, Purpureocillium lilacinum
MKLSLLFAILPAVLAAPAVKRDEPAPLLTPRGASQLINGKYIVKFKDGMSIASVDKTVSALSSKADRVYNHIFRGFAGNLNANDLKTLRDHPDVEYIEQDAIITINAYTQQPGAPWGLGRISHRSKGSTTYEYDTSGGSGTCAYVIDTGVEASHPEFEGRASQIKSFISGQNTDGNGHGTHCAGTIGSKTYGVAKKTKIYGVKVLDNSGSGSYSGIISGMDFAVQDSKTRSCPKGVVANMSLGGGKAQSVNDGAAAMIRAGVFLAVAAGNDNANAANYSPASEPTVCTVGATTSSDARSSFSNYGSLVDIFAPGSNILSTWIGGTTNTISGTSMATPHIVGLGAYLAGLEGFPGAQALCKRIQTLSTKNVLTGIPSGTVNYLAFNGNPSG

SEQ ID NO: 171 - protein, 388 aa, Metarhizium anisopliae
MHLSALLTLLPAVLAAPATIGRRAEPAPLFTPQAESIIADKYIVKFKDDIARIATDDTVSALTSKADFVYEHAFHGFAGSLTKEELKMLREHPGVDFIEKDAVMRISGITEQSGAPWGLGRISHRSKGSTTYRYDDSAGQGTCVYIIDTGIEASHPEFEGRATFLKSFISGQNTDGHGHGTHCAGTIGSKTYGVAKKAKLYGVKVLDNQGSGSYSGIISGMDYVAQDSKTRGCPNGAIASMSLGGGYSASVNQGAAALVNSGVFLAVAAGNDNRDAQNTSPASEPSACTVGASAENDSRSSFSNYGRVVDIFAPGSNVLSTWIGGRTNTISGTSMATPHIAGLAAYLSALQGKTTPAALCKKIQDTATKNVLTGVPSGTVNYLAYNGA

SEQ ID NO: 172 - protein, 389 aa, Hirsutella rhossiliensis
MKLSLILAILPAVLAAPATKRDEPAPLLIPRGSKQLIADKYIVKFKDSMSIAAVDKTVKALSNKADHVYTNTFRGFAGQLSAKDVKALRERPDVEYVEQDSIVTINALKQQPGAPWGLGRISHREPGSTTYVYDSSAGQGTCAYVIDTGVEASHPEFEGRATMVRSFINGQATDGHGHGTHCAGTIGSKTYGVAKKTKIYGVKVLSNQGSGAVSVIIAGMDFAVQDSRKRSCPKGVVANMSLGGGFSAAINNAAASMIRSGVFLAVAAGNDNTDASGSSPASEPTVCTVGASTISDQRSSFSNYGSVVDIFAPGSDILSTWIGGRTNTISGTSMATPHIAGLGAYLAGLEGFSDPQALCSRIQELATSDVLTDIPDGTVNKLAFNGASQ

SEQ ID NO: 173 - protein, 389 aa, Tolypocladium inflatum
MRLSILLSILPMVLAAPAAKRDEPAPLLVPRGNHELIADKYIVKFKEGSALSVLEDTMSSLTGNADHVYDVVFKGFAGHLDKVMLDVLRGHPDVEYIEQDAMVTINGFVSQPGATWGLGRVSHRQPGATSYDHDSSAGAGTCAYVIDTGVEASHPEFEGRAAQVKSFINGQNSDGNGHGTHVSGTIGSKSYGIAKKTKIYGVKVLDNQGSGSFSSIIAGMDFVAKDAKTRGCPKGAVANMSLGGGYAASVNQAAAALVNSGVFLGVAAGNSNTDAGSTSPASETSACTVGATDRNDNRSSFSNYGSVVDIFGPGSDILSTWIGGRTNTISGTSMATPHIVGLAAYIGGLEGRTGGAVCNRLQELATRNAIRGVPSGTKNLLAFNGNPSG

SEQ ID NO: 174 - protein, 387 aa, Metacordyceps chlamydosporia
MQLSVLLTLLPAVLAAPAIVEQRAEPAPLFTPKSSIIAGKYIVKFKDGVARIAADEATSALSAKADHVYSHLFNGFAGSLTKEELQTLRNHPDVDFIEKDAVMTANAIVEQQGAPWGLGRISNRQKGSTTYRYDDSAGNGACVYVLDTGIETTHPEFEGRATWLKSFIDGENNDGHGHGTHCAGTVGSKTYGVAKKAKLLAVKVLDNGGSGSYAGVIAGMEFVSQDYKTRGCPNGAIASMSLGGPFSASVNQAAAAMVSSGVFLSVAAGNDGADAARYSPASEPSACTVGATTSTDARSSFSNFGKLVDIFAPGSAILSTWINGGTRSISGTSMATPHVAGLAAYLNALQGVVSPAALCKKIQDTAIKNALTGVPASTVNFLAYNGA

SEQ ID NO: 175 - protein, 387 aa, Cordyceps militaris
MRLSLLLAILPVALAAPATKRDEPAPLHAAAVESAAIPGKYIVKFKKGSASADNRMHIMAEHAEHVYTNVMQGFAGSLDAETLKALRNHPDVEYIEQDARVSINGWVTQPQSTWGLSRISHRAKTAKGYTYDSSSGEGTCVYVIDTGIDDSHPDFGGRALQVKSFVDGEPADGHGHGTHCAGTIASNTYGVAKKTKVFGVKVLDNNGSGSWSNVIAGMDFVVNDSRERDCPSGTLASMSLGGGYSAAINGGAAELVSSGVFVSVAAGNDNRDAANYSPASEESACTVGATTSADARSAFSNYGRIVDIFAPGSNILSLAPGGGTATMSGTSMAAPHIAGLAAYIGGLEGLTGGSICNRLVQLATRGTLAGIPGGTVNLLAFNGNPSG

SEQ ID NO: 176 - protein, 379 aa, Fusarium sp.
MRLSIIAVLPLALAAPVLEPAPLLEARGSQPIAGKYIVKLKDTAKIGIMEATAKVANPERVYQNVIKGFSASLCKEEVERLRHDPDVESIEQDAIISINAITQQQGATWGLTRISHRQRGSTAYAYDTTAGQGACAYVIDTGVEDTHPEFEGRAKQIKTFASTARDGNGHGTHCSGTIGSKTYGVAKKVSIFGVKVLDDNGSGSLSNVIAGMDFVASDYRSRNCPRGVVASMSLGGGYSATVNQAAARLQSSGVFVAVAAGNDNRDAANTSPASEPSVCTVGATDSSDRRSSFSNYGRALDIFAPGTDITSTWIGGRTNTISGTSMATPHIAGLGAYLLALEGGSASTICARIQTLSTKNAISGVPSGTVNYLAFNNAT

SEQ ID NO: 177 - protein, 383 aa, Neurospora tetrasperma
MAAPSAPIDKRAPILEARAGTQAVPGKYIVKLRETASDDDLDKAVKKLGNSKADHVYKHAFRGFAGRIDDKTLDEIRSIPEVEYVEQEAVFTINTYTSQSSVPSWGLARLSSKTKGKTTYVYDSSAGAGTCAYIIDTGINTAHSDFGGRATWLANYAGDGINSDGNGHGTHVAGTVGGTTYGVAKKTNLYAVKVLDSNGSGSNSGVIAGMNFVAQDAQSRNCPNGTVANMSLGGGYSASTNSAAAAMVRAGVFLAVAAGNDGANAANYSPASEPTVCTVGATTSADAIAYYSNYGTIVDIFAPGTSITSAWIGSTTAKNTISGTSMATPHITGLGAYLLTLLGKKSPAALCSYIASTANSGVISGIPSGTVNKLAFNGNPSAS

SEQ ID NO: 178 - protein, 393 aa, Chaetomium globosum
MHFSVALLALLPAAIAAPTAEPIQKRAPIIAARVGQVVPNKYLIKLREGTSDDALEAAIGKLGKSKADHIYRGKKFRGFAGKLEADLLDQIRLLPEVEYVEEDAIFSINAYVSQSGAPWGISRLSHKSAGSTTYVYDSSAGEGTCSYVIDTGIYTAHSDFGGRATFAANFVDSSNTDGNGHGTHVAGTIGSTTYGVAKKTKLYAVKVLGSDGSGSTSGVVAGINFVATDAPKRSCPKGVVANMSLGGGYSASINQAAAALVDAGIFLAVAAGNDNANSANYSPASEASVCTVGATDSSDRKASYSNYGSVVDIQAPGTNILSTWIGGRTNTISGTSMASPHIAGLAAYLLALEGSKTPAALCNYIKSTALSGAVSGLPSGTTNRLAFNGNPSA

SEQ ID NO: 179 - protein, 396 aa, Neurospora crassa
MKLSAVLALLPLAMAAPSAPIDKRAPILEARAGTQAVPGKYIVKLRETASDDDLDKAVKKLGNSKADHVYKHAFRGFAGRIDDKTLDDIRSLPEVEYVEQEAVFTINTYTSQSSVPSWGLARLSSKTTGKTTYVYDSSAGAGTCAYIIDTGINTAHSDFGGRATWLANYAGDGINSDGNGHGTHVAGTVGGTTYGVAKKTQLYAVKVLDSNGSGSNSGVIAGMNFVAQDAQSRNCPNGTVANMSLGGGYSASTNSAAAAMVRAGVFLAVAAGNDGANAANYSPASEPTVCTVGATTSADAIAYYSNYGTIVDIFAPGTSITSAWIGSTTAKNTISGTSMATPHITGLGAYLLTLLGKKSPAALCSYIASTANSGVISGIPRGTVNKLAFNGNPSAY

SEQ ID NO: 180 - protein, 397 aa, Fusarium oxysporum
MRSATLLALLPFALAAPSRRAEPAPILRPRGVKLVDGKYIVKMKNGFQASSIESWVDKMIDSIEADADYTYSKGFGGFAASLKDDELNKLKHDPNVEYIEQDAYISITATTQQSNAPWGIARVSSQSPGGSTYTYDDSAGEGTCAYVIDTGIDVDHPDFDGRAKFLKNFAGGSDSDGQGHGTHVAGTIGSTTYGVAKKTSLFAVKVLGDDGSGTNSAVIAGMDFVSGHAKDENCPNGVVVNMSLGGETSDAVNQAAKAIVDAGLFLAVAAGNDGKDASGSSPASEESACTVGATTRDDTLADYSNFGSVVDVLAPGTDILSTWPNGKTNTISGTSMASPHVAGLAAYFLGLGQKAEGLCDYIASKALDGVISNVPSGTVNKLINNGVGGSNSSSIRH

SEQ ID NO: 181 - protein, 389 aa, Gibberella zeae
MRSATLLALLPFALAAPSASVSRRTEPAPVIRPRGVKLVDGKYIVKMKAGVRAASVDSAVSTIQADADYTYTKSFSGFAASLKDEEIETLKHDPNVEYIEQDAVITIKATVDQDNAPWGIARLSSSKPGSKTYTYDESAGEGTCSYVIDTGIDVEHPDFDGRAKFLKNFAGGRDGDGQGHGTHVAGTIGSTTYGVAKKTTLYAVKVLGDDGSGTNSAVIAGMDFVAGHADDENCPNGAVVNMSLGGEASDAVNSAAKSIVDAGLFLAVAAGNEAVDASGSSPASEASACTVGATTRNDTLSYFSNFGDLVDVLAPGTDILSTWPGGKTNTISGTSMASPHVAGLGAYFLGLGKKAEGLCEYIASQALEGVVAQVPRDTVNKLINNGVSK

SEQ ID NO: 182 - protein, 399 aa, Trichoderma reesei
MQPSFGSFLVTVLSASMAAGSVIPSTNANPGSFEIKRSANKAFTGRNGPLALARTYAKYGVEVPKTLVDAIQLVKSIQLAKRDSATVTATPDHDDIEYLVPVKIGTPPQTLNLDFDTGSSDLWVFSSDVDPTSSQGHDIYTPSKSTSSKKLEGASWNITYGDRSSSSGDVYHDIVSVGNLTVKSQAVESARNVSAQFTQGNNDGLVGLAFSSINTVKPTPQKTWYDNIVGSLDSPVFVADLRHDTPGSYHFGSIPSEASKAFYAPIDNSKGFWQFSTSSNISGQFNAVADTGTTLLLASDDLVKAYYAKVQGARVNVFLGGYVFNCTTQLPDFTFTVGEGNITVPGTLINYSEAGNGQCFGGIQPSGGLPFAIFGDIALKAAYVIFDSGNKQVGWAQKK

SEQ ID NO: 183 - protein, 401 aa, Trichoderma atroviride
MQPTTSFGTFLVTFLSASMAAGSAIPYMAPQPGSFEIKRAANNGFTGRNGALALARAYAKYGVPVTDTLLEAVETLKSAHLIKRSSGNVTATPDGDDLEYLVPVQIGTPPQTLNLDFDTGSSDLWVFSSETDTSSSQGHSVYSPSKSTSAQKLDGATWSITYGDQSSSSGDVYTDVVTLGSLTVKSQAVESAQQVSAQFAQGNNDGLLGLAFSSINTVKPTQQKTWFDNISGSLDSPLFVADLRHETPGSYIFGTIPSDASNVLYAPVDNSQGFWQFSTSSDIGGSFSAIADTGTTLLLASDDLVSAYYKNVQGAREDQQQGGYVFDCSTTLPDFTFTVGDGKITVPGSLINYGQASGSECFGGIQSSGGLPFAIFGDIALKAAYVVFDSGNTQVGWAQKK

SEQ ID NO: 184 - protein, 400 aa, Trichoderma virens
MQPVSFGSFLVTFLTASLAAGSALPNTVSSPGSFEIKRTPNKGFTGRNGPLALARAYVKYGVPVSKSLVEAIDLVKSAQLIKRSNGNVTATPDGDDLQYLVPVQIGTPPQTLHLDFDTGSSDLWVFSSETDPSSSKGHSLYNPSTSTSSKKVDGASWNITYGDQSSSSGDVYTDVVTVGSLTVNSQAVESAQQVSAQFAQGNNDGLVGLAFSSINTVKPTPQKTWFDNIASTLDAPLFVADLRHETPGSYIFGAIPSAASNILYAPVDNSKGFWQFSTSSDTGGEFDAIADTGTTLILASDALVKSYYQKVQGAHLDALQGGYVFGCNTTLPDFKFAVGEGEITVPGSLINYAPAGNNECFGGIQPSGGLPFAIFGDIALKAAHVVFDSGKTQVGWAQKK

SEQ ID NO: 185 - protein, 398 aa, Cordyceps militaris
MYKDVFPCSGFKSFGSFLVAALVAGFASGNPMPRASGSFELKQTANPNFSSRNGPQALANAYKKYGKAVPDHIAVAADKNTNAKRAAGTATANSIRGDLEYLVDVQIGAGQTLKLDFDTGSSDLWVFSTQTEGAGFQTKYDPSRSSSAKRLSGATWEISYGDGSNCSGDVYTDDVTVGGLTVKGQAVEAAQEVSQQFAQGQSDGLLGLAFSQLNTVTPQKQKTWFDNVKPQLDSPLFVADLKHNAPGSYIFGKIPSGAEQASYVDVDSSQGFWGFSATTMYGDVQAIADTGTTLLLLDNQSVQSYYANVQSAEYDQQEGGFVFNCGEQLPDFPFRVGGGIITIPGAIIKYAQGSDGRCFGGIQAAGNIPLNIFGDIALKAAYVIFDGGNNRLGWAQKN

SEQ ID NO: 186 - protein, 446 aa, Trichoderma reesei
MTLPVPLREHDLPFLKEKRKLPADDIPSGTYTLPIIHARRPKLASRAIEVQVENRSDVSYYAQLNIGTPPQTVYAQIDTGSFELWVNPNCSNVQSADQRFCRAIGFYDPSSSSTADVTSQSARLRYGIGSADVTYVHDTISLPGSGSGSKAMKAVQFGVADTSVDEFSGILGLGAGNGINTEYPNFVDELAAQGVTATKAFSLALGSKAEEEGVIIFGGVDTAKFHGELAHLPIVPADDSPDGVARYWVKMKSISLTPPPPSSSGSTDDNNNKPVAFPQTSMTVFLDSGSTLTLLPPALVRQIASALGSTQTDESGFFVVDCALASQDGTIDFEFDGVTIRVPYAEMIRQVSTLPPHCYLGMMGSTQFALLGDTFLRSAYAVFDLTSNVVHLAPYANCGTNVKSITSTSSLSNLVGTCNDPSKPSSSPSPSQTPSASPSSTATQKA

SEQ ID NO: 187 - protein, 608 aa, Trichoderma atroviride
MAIRSFLTLSLALLAHARPRHVFDPEDVGTKITLPVISAPRAVEAVAGRSAGDDEDKPFHILPFPYTGNGKRAILEDDDGAAGAVTLPVPRPASRRSAGDENEDEEDKPFHILPFNEKRKLPVEEGPIGTITLPVIHAARPVLDKRAVEVQVENRSDVSYYAQLNIGTPPQTVYAQIDTGSFELWVNPDCSNVASSDRRFCQAIGSYNPRSSSSAATTDESAMLRYGIGSANVSYFKDTIALSGAPAMKQVQFGVASASVDEFSGILGIGAGEGVNTDYPNFIDALAAQGVTKTKAFSLALGSKAEEEGVIIFGGVDTAKFQGKLATLPIVPAKESPDGVARYWVRMNSIALSPPQGKATTFSQTDMTVFLDSGSTLTLLPEQVVEEIATGLGSSGMDSTGYYAINCNLASQKGTIDFAFDGVTISVPYSEVIRQVSSSPPQCYLGMMGSTEFALLGDTFLRSAYAVFDLTGNSIHLAQYANCGTKVLTITPDSALQGLSSSCGGGSESPANPPASSSSSAAPAAPSKSAASKPSAPASSSVQPVHSPTPAASKPADQTPPATTTAASTPKSTPSSVSDAAGKSSAGRVNVQAVGWSMVSAAMGLLLL

SEQ ID NO: 188 - protein, 655 aa, Trichoderma virens
MGISSFLVLSLAVLAQARPRHAFEPEDVGDRITLPVISARAVDVKGDLSQRSAADEEDKPFHILPFPYPSKRDVESREEEDKPWHILPFPYPSKRDVESREEEDKPWHILPFPGPSKRKILEDDDGADGRITLPVPQRARRSEGEEDKPFHILPFNDKRKLPVEDVPSGTITLPIIHRHRSFLDKRAVEVQVENRSDVSYYAQLNIGTPPQTVYAQIDTGSFELWVNPDCSNVQTGDQRFCRAIGVYDPKSSSTSFVTGSAAQLRYGIGSANVSYVQDSISLPGSATMKQVQFGVALSSVDEFSGILGIGAGDGFNTLYPNFIDELASQGVTKTKAFSLALGSKAEEEGVIIFGGVDTGKFTGKLANLPIVPADDSPDGVARYWVGMNSISLSPPNGKSTTFAQTKMTVFLDSGSTLTLLPQSLVNEIADGLGSTGTDDSGFAIVDCDLANQPGTIDFAFDGVTIKVPYSEMIRSVNSLPPHCYLGMMGSTQFALLGDTFLRSAYAVFDLTGNMIHLAQYVNCGTNVKSITSTSSLLGLAGSCSSDGSESPSSPSSSSTSSSPSKTASKAAPSATAPSSSTVQPPSSAQSTAASPSAARSSDAASTTAANTAKSSATGGADAESAQSGDKNGAGKTGVHSLAISMVFAAMGLLLI

SEQ ID NO: 189 - protein, 545 aa, Glomerella graminicola
MTLPVIPYTTQDKTNVAPRGLSLPADEDAETSMMMTLPVTSHQRRKRRTRSPRKVLLDDILDSNLAPLPAAPVVKPPISMRGLPVVDGADANGAFVTLPVIHSTKRGVFSRQVEAKLANRSDVAYYAQLNIGTPPQAVYAQLDTGSFELWVNPDCNVLAASDQRFCEAVGFYDPARSTTSVQMQTTKTLRYGIGAANISYVRDSLALAGSSSTMRQVQFGVATSSEDQFAGILGIGAGEGVNTRYKNLIDELAAQGVTRTKAFSLGLGSKDEQEGAIIFGGIDTSKFSGPLARLPIIPADEAPDGVARYWVNMQSLSLTPPSRRTRLYANSSMPVFLDSGATLTLLPEELANMIAADFGSSGIDANGFYPVSCNLVGLNGTVDFDFDGMKIQVPYSEIIRELRTTPPTCYLGIVPNADFTLLGDTFLRSAYAVFDLDSNVAYLAQYTNCGTRTMPINQPQDIAAIRGLCPSPAGPGGSLPAANGTTNSPSSSSGSNRVPSTGSNVPGSPTPETSGVPAGTASAARATGRSMLATVSALLLAAMFW

SEQ ID NO: 190 - protein, 544 aa, Metarhizium acridum
MVSFLITTAVLSLSLSVHGWPQVRNESRFFGEEIRAENIVADISSRELPFVGEALSVGTLPVPQLSQRDDAVGSLEATEDDQDSSSNNSFQEDAKRGPPEGDISPGHLTLPVLHVERRLDKRDVEVRLENRSDVAYYVQPNLGTNPDPKKFKVNIGNPVQKVFAQLDTGSFELWVNPDCTSLPSSADKQFCQAVGQYNPLRSSSSKGSNLSTELRYGIGSAQITYFLDDIALVDSRQMKQVQFGVARSTKDQFSGILGIGHGVGVNTGYRNFVDQLADQGITKTKAYSVALGSKADRAGVVVMGGVDTAKFAGRLTPLPLIPGDKSPDGVTRFWVNLTSVQHNSESGRTANLTGATMPVFMDTGATLTLLPPRLANDIARRVGARGLDRNGLYMVDCGVAGKNGSLDFNFDGVTIRVPYSEMVREIATLPPSCYLGIMPSTSFTLLGDTFLRSAYVLFDISNNMTYMAPYANCGSKTQSIDSSTDLTSIVGTCSPQQVNELSKPVGGGSSDGNSGNKDNGAGLARMSWSWFGVLGAFAIGALTL

SEQ ID NO: 191 - protein, 506 aa, Thielavia terrestris
MAFSFLLLPTVLLIPLFCRHVTALQATALRQTAHDPGCVHLPVIHSTNVNYFSSKRAVQLQLANRSDVAYYAQLSIGTPPQPVFVQLDTGSFELWVNPDCTSITGADAAFCERTGQFDTKKSSTAISLGATKTLQYGIGSANITYFTDTITLAGSSAALQAVQFGVATASQDASSGILGIGYGKGIATNYPNFIDQLRAQNVTRVKAYTLALGSKDVEEGVIVFGGVDTSKFAGKLAKLPIIPAAQSPDGVPRFWVEMQSVSMTPPNGVSHVYNASSTPLFFDSGSTMTLLPPDLTNAIARDFGAQGPDANGFFRIDCALTTLNGTVDFAFDGVTIKVPYKELAREVASSPPVCFLGIMSSDRFTLLGDTFLRSAYAVFDLETNAIWLSQAENCGSSPAALNNIQDLAAVTGKCGVTEAADKDTSSTAVSSVAPESAEALPAPTASTVGLAATGTTSPGRTTPTAPTASTTPTTPSSSAGSCFRGQAGIVWVVGVMMLLHMLKLVL

SEQ ID NO: 192 - protein, 524 aa, Podospora anserina
MAFSLLLSASVLLLSSTFSGHAVASSLPFTNTTIPPTNVSIPHTHAPIKLINSSVIAHDDGCVHLPIVHSTNANHFSKKRGVQLQLANRSDIAYYAQLSIGTPPQPVFVQLDTGSFELWVNPDCTTVQGADAAFCQQVGRYDGNTSSTAKSLGTTKTLKYGIGTANITYFEDTITLAGTATALQAVQFGVATATEDTFSGILGIGYGKGIATKYKNFVDQLVAQNAIRAKAYTLALGSKEEKEGVIVFGGVDPSKFAGPLAKLPIIDANNSPDQVPRFWVDMNSIAITPPNNDTKVYEGSKMPVFLDSGSTMTLLPPDLAATIAKDFGADKEDDNGFYRIDCGLTSMNGTLDFSFNGLNIRVPYKEMIREVPSNPPACFLGITPSKKFTLLGDTFLRSAYVVFDLETNSIWMTQATSCGSTPAALGSVNDLSMVVGACGLTAEPAVTVSSAGGTTATPGVGVGGGGTGSDTNGASATVSTVVVPESPPGATSTAGSPVTSSSSRCHPMAVVAMAFALLALANMG

SEQ ID NO: 193 - protein, 496 aa, Chaetomium thermophilum
MAVPFLSSCLVLSTVWLSSLVTAQHLPHEKGCVHLPIVHSTNARLFGKRGVQLQLANRSDVAYYAQLSIGTPPQPVFVQLDTGSFELWVNPDCTTVEGADAVFCERVGQYDASKSSTAVSLGTSRTLRYGIGTANITYVTDTITLAGTGTTLQGVQFGVATATEDAFSGILGIGYGKGIATRYLNFVDQLKEQNATKVKAFSLSLGSKDAQEGVVVFGGVDTSKFAGHLTQVPIIPASQSPDGVPRFWVSMRSLAMTPPSGISKHYSGSEMPVFLDSGSTMTLLPPNLTEAIARDFGSKSEDAYGFHQIDCSLTKLNGTLDFYFDGVMIKVPYKELTREVPTNPPACFLGIMASDQFTLLGDTFLRSAYALFDLETDSIWMTQAANCGSTPAALNSVEDIQRITGLCDLSVPADNTTSSTEAFTPMTEVDQVSMTTVTSVTPIHTSTTATSPTEEVSIQSSATSISGANKLGRGNMEGILFWGPGVVIALHVLIGV

SEQ ID NO: 194 - protein, 479 aa, Verticillium dahliae
MTLPVPVTGGRGDQHDGEASRRQLPVDDDDDDTGAFYTLPIIHSTKRGVFSRQIEVELANRSDVAYYAQLNIGTPPQPVYAQLDTGSFELWVNPDCTVLRPADQRFCQAVGVYDPARSSSSSLLSSTASLRYGIGTANISYVRDDVSFAGSPVLSHVRFGMATATTDQFAGILGLGHGKNYTVTYPNMMDELVAQGAIRTKAYSLALGSKTEQQGLLVLGGIDTAKYSGHLAALPVIPAQQAPDRVARFWVNLRSLALTPPSGVTRAPYVAAAGLPVFLDSGATMTLLPRALADAIAADFGAPPSSSPDDPETSHTFYEVDCSMADAPGTLDFSFGRSLTIRVPYAEMVRRTRADPPRCVLGFVPDDDFALLGDTFLRSAYAVFDLESDVVYMAQYRNCGERPMAVRRVQDIHAIVGLCEAPARPSQAVAAPDTAPTEAATFASGPVPGLVDVSAAAGLSLSRAWVWSIAFAMVLVHVA

SEQ ID NO: 195 - protein, 489 aa, Myceliophthora thermophila
MAIPVLFSALVLLVALLCCHATAALQQLAHDVGCVHLPVVHSTKVDRFSDKRGIQLQLANRSDVAYYAQLSIGTPPQPVFVQLDTGSFELWVNPDCTTVSGSDAVFCERAGRYDVTKSSTATSLGTNRTLRYGIGAANISYFTDTISLAGSPMMLQDVQFGVATASEDAFSGILGIGYGKGIGTGYPNFVDQLWEQNVTRVKAYTLALGSKDSQEGVIVFGGVDTSKFAGKLARLPVIPPAQSPDGVPRFWVEMKSLSITRPSGLNTVYDGGAMPVFLDSGSTMTLLPANLTMAVARDFGAQAPDANGFYKIDCALTALNGTLDFAFDGVTVRVPYKELTREVASNPPSCFLGIVASDRFTLLGDTFLRSAYTVFDLETDSIWMAPAVNCGSSPAALSNVQDLSAVTGECGVREIAESTSSTQVPSTGVDDTEAGAVPTSTTTVVSQPSGTTTQMGARPTLDNASNPLGAHRLTWVLVITAALHLFTGI

SEQ ID NO: 196 - protein, 518 aa, Neurospora crassa
MAAFPFLSASFVLLQLALTCLAQHLNLTTGPLHLTGHTPGDGCVHLPIIHSTNTDHFARRGIQLALNNRSDVAYYAQLEIGTPPQTVYTQLDTGSFELWVNPDCTTVSPSDSSFCDHIGFYNASLSSTSKSLGTSKTLRYGIGAANISYVTDTISLSGSSTSLKDIQFGVATSSKDAFSGILGIGYGQGLATKYPNFIDQLYAQKITKVKAYTLALGSKTAQQGSIVFGGVDTSKFAGPLGRLPIIPAEDSPDGVPRFWVQMNGISLTPPSGQSMGVYEGSKIPAFLDSGSTMTILPPALANKIAEDFGSPEMDANGFYRVGCGYVEMNGTMDFEFVGAGQKVTVRVPYKEMIREVGQGESKMCFLGIMGSESFTLLGDTFLRSAYATSCGNTPAALRDVTDLSRVVGNCQIQLGEKEAVVDVVSETSIAPPTGSTGDTDGVTGTGGNGSGNGGTRTAWGFVTTTLAVPMATGLAGVGGSGSGSMSATALDSSGRSMAGDVVLSAAVAVGAAVLGSLL

SEQ ID NO: 197 - protein, 497 aa, Magnaporthe oryzae
MAATSIRGLLLLAVAAAAGPLEAAQEPHDPGCLHMPIMHMSKAEQYQKRAVKVPFDQRFDVGYYTKLSFGTPAQEALVHLDTGSFELWINPTCNNLDGAGEQQFCRAGGSYDPAQSTTVQRLGTTNTLRYGIGSANISYVKDTVGIPGTNMSVRSAQFGVATSSETQNAGILGIGHGVGQAIGYRNFIDELKAQNVTKTRAFSVALGGKDEKQGTVVFGGVDTSKFAGGLARLPIIPAAQSPDGVRRYWVNMSSISLHPPSGRNKTYPGTNMPVFLDTGSTLTLLPEALVKSVASDFGSMQQDAGGYWPVDCSLVGINGTMDFAFDGVTIKVPYKELIRQFGNSCVLGLSSHSSFTLLGDTFMRSAYFVFDQDSDCVWMTQYTNCGSTPAALASVASLRTLQGACPLKQGSVSAVTAGTAGAAAPSTTASPKAPGAGGGSGSNGGGGAKGSPPPGASASAPDSKLKNAGGRAMQVPAISSAVVTLVLTTLAALHLAL

SEQ ID NO: 198 - protein, 434 aa, Chaetomium globosum
MPQHSNKPSTTTVSLGTPPQPVFVQLDTGSFELWVNPDCTTVSGGDAVFCQRAGRYESTASSTATSLGTTRTLRYGIGAANISYFTDTISLAGSPMSLQDVQFGVATASVDAFSGILGIGYGKGIATRYPNFVDQLREQNATRVKAYTLALGSKDAQEGVIVFGGVDTSKFAGKLAKLPILPAAQAPDGVPRFWVDMQALSITPPNGVTTVYEGSSMPVFLDSGSTMTLLPANLTAAVARDFGAESPDSNGFYMIDCALTALNGTLDFVFDGVTVKVPYKELTREVASTPPSCFLGIMASDRFTLLGDTFLRSAYTVFDLETDSIWMTQATNCGSSPAALSNIQDLSVVVGECGAGASEDIDTTSSTQFPSTAVEDFESGAIPTSTGSFGPQVSEVAPPDQARPLPENSGPSLRAAGFIWNLGMAGAVHLLAGL

SEQ ID NO: 199 - protein, 467 aa, Magnaporthe oryzae
MKNTALLVATAAASVAAVGIAEIPREQVSTSSQPSTSDPGFVSFPIYHRSVSKPILKRNTDVTIYNISSVSYLIQLSIGTPGQQVKVAIDTGSDELWVNPNCTAVKSQDQRAECIADGQYNPGQSSTSQVSTTSNNIPYGKGDVNITYYKDSISMSNSSISLTNVIFGVATSSKDLNEGIMGLGYGDGVNLRYNNMVDSLFLQNVTKSRAFSVALGSAEASNSGVISFGGVDTKKFSGKLGQMPILGPQGKEEIRRYWVPMDSIAMSKNGGNKTYSGGNIPIVIDSGSTLSYLPSSVVTAMAMDANALWNSEGGVYFVKCDKMPADASFDFSFNNGSFRISVPWRNFFWNTGGNTCVLGAVPIKSGSVTALLGDSFMRSVYTVFDQTSNMVFMAPYANCGSNEQMIPASPSGAAANFTGECSPGQGLPDPTPQKNAAGKASGEPSKFEFWACAAVLVVGHLVFGMLL

SEQ ID NO: 200 - protein, 387 aa, Trichoderma reesei
MGLVTNPFAKNIIPNRYIVVYNNSFGEEAISAKQAQFAAKIAKRNLGKRGLFGNELSTAIHSFSMHTWRAMALDADDIMIKDIFDAEEVAYIEADTKVQHAALVAQTNAAPGLIRLSNKAVGGQNYIFDNSAGSNITAYVVDTGIRITHSEFEGRATFGANFVNDDTDENGHGSHVAGTIGGATFGVAKNVELVAVKVLDADGSGSNSGVLNGMQFVVNDVQAKKRSGKAVMNMSLGGSFSTAVNNAITALTNAGIVPVVAAGNENQDTANTSPGSAPQAITVGAIDATTDIRAGFSNFGTGVDIYAPGVDVLSVGIKSDIDTAVLSGTSMASPHVAGLAAYLMALEGVSNVDDVSNLIKNLAAKTGAAVKQNIAGTTSLIANNGNF

SEQ ID NO: 201 - protein, 445 aa, Trichoderma atroviride
MAPFNTMLGYLLLAVAPLAAALPFHGHGHNTNNHNLNLNFNLTETINEINENLAGLVGYITNPHAKNVIANRYIVVYNNTFGSEAIAAKQAEFAATIQKRNLGKRSLGGNLLSTEIHSFQMHNWRAMALDADDEMVKSIFSAQEVAYIEADAVVQTKGALVAQTNATPGLIRLSNRNAGGKNYIFDNTAGAGITAYVVDTGIRITHSEFEGRASFGANFVNSNNTDENGHGSHVSGTIGGATFGVAKNVKLVAVKVLDATGAGSNSGVLNGMQFVVNDVQAKGLSGKAVMNMSLGGSLSAAVNNAIAAIANAGVVPVVAAGNENQDTANTSPGSAPQAITVGAIDATNDVRASFSNFGPDVDIYAQGVNVLSVGIKSDTDTAVLSGTSMATPHVAGLAAYLMALKGLTNVDDVTTLIKNLATATGASVQQNVAGTTNLIANNGEL

SEQ ID NO: 202 - protein, 437 aa, Trichoderma virens
MAPFNTMLAYLLLVVAPLAAAVPFHNRHSLGGPQTHAHNTVNNINLAHLMNIVVNPTAKNIIPGRYIVVYNNTFGDEAISAKQAQFASTIAKRNLGKRNLVGNLLSTEIHSFKMHTWRAMALDADDDMIKNIFDAEEVAYIEADTKVQNTALVAQTNATPGLIRISNRNVGAANYIFDTSAGTGITAYVVDTGIRVTHTEFEGRATFGANFVNTNNTDENGHGSHVAGTIGGATFGVAKNVKLVAVKVLDASGSGSNSGVLNGMQFVVNDVQAKKLGGKAVMNMSLGGSFSTAVNNAITALANAGIVPVVAAGNENQDTANTSPGSAPQAITVGAIDATNDVRASFSNFGAGVDIYAPGVDVLSVGIKSDIDTAILSGTSMATPHVAGLAAYLMALQGVSNVNDVTNLIKNLAAKTGADVQQNVAGTTNLIANNGNL

SEQ ID NO: 203 - protein, 433 aa, Hypocrea lixii
MAPFNTMLAYLLMVVAPLAAAMPFHNRHSLSPQTHQHSALNMTHLMSVVINPHAKNIIPGRYIVVYNNTFGDAAISAKQAQFATAIAKRNLGKRDGLGNLLSTEIHSFQLHTWRAMALDADNDMIKSIFDAEEVAYIEADTKVQNTALVAQTNATPGLIRLSNKDVGGQNYIFDNSAASGMTAYVVDTGIRVTHTEFEGRATFGANFVNTNDTDENGHGSHVAGTIGGATFGVAKNIKLVAVKVLDASGSGSNSGVLNGMQFVINDVQTKKLAGKAVMNMSLGGSFSTAVNNAITALANAGIVPVVAAGNENQDTANTSPGSAPQAITVGAIDATNDVRASFSNFGAGVDIYAPGVNVLSVGIKSDIDTATLSGTSMATPHVAGLAAYLMALEGVTNVDDVSNLIKNLATKTGATVQQNVAGTTDLIANNANL

SEQ ID NO: 204 - protein, 442 aa, Fusarium oxysporum
MALLRTFLASLLVAAPFAAAAPIDVAETLGDMADSIGGGLGGEADKKMGISAFLRPMLKNPDALNVIPNRYIVVYNDTFDDDTISAKEASFAAAIKKRNLNKRSSIGKAMSTSIQSFRMNKWRAMSLDADDLMVQDLWNSDEVAYIEADTKVQLNAAIAQVNAPPGLDRLSHAKVNQDTYVFDDSAGEGITAYVVDTGIKIDHSEFEGRATFGANFINNVDDDENGHGSHVAGTIGGATFGVAKKVDLVAVKVLDASGGGSNSGVLQGMQFVIDDAKKKNRVGKAVMNMSLGGDFSQAINRAIEALFKAGIVPVVAAGNENRETALTSPGSAPNAITVGAIDATTDERADFSNFGPEVDVYAPGVNVLSVGIKSNTDTATLSGTSMASPHVAGLAAYLMGFQQLDGPAQVASLIKSLAGQTGAKVQNNVQGTTDSIANNGNQ

SEQ ID NO: 205 - protein, 446 aa, Gibberella zeae
MAFLKTFLASLLIAAPLATAAPVDVAQTIGNMAEAVGSDIGGGLGEELDKKMGISAFLRPMLSNPDSLNIIPNRYIVVYNDTFDDDAIAAKEFSIASAIKKRNLNKRSSIGQAMSTSIKSFRMNTWRAMSLDADDMMVQDLFKSDEVAYIEADTRVQLNAAIAQVNAPPGLNRLSHAQADQENYIFDDSAGEGITAYVVDTGIKVDHSEFEGRATFGGNFIDNVDDDENGHGSHVAGTIGGATFGVAKKVDLVAVKVLDASGGGSNSGVLQGMQFVVDDVKKNNRAGKAVMNMSLGGDKSEAINRAIEALFKAGVVPVVAAGNENRETALTSPGSAPNAITVGAIDATSDQRADFSNFGPEVDIYAPGVDVLSVGIKSNTDTATLSGTSMASPHVAGLAAYLMGFQKLDGPAQVASLIKSLAAESGAKVRNNVRGTTDGIANNGNQ

SEQ ID NO: 206 - protein, 423 aa, Glomerella graminicola
MVRPIAILAAVLPAVLAAPFGLNENKAANNTDTFMGVPISNLNALDLIPNKYIVVYNNSFDDDAITSKMSSFAAAIKKRNIGKRSLDGRSLSTSTRNFKMNNWRATVMEADDNMIMNVMSAEEVAYVEQDAKVKISATVSQTNAPPGLVRLSHAAAGETGYVFDQVSGDGITAYVVDTGILTTHSEFQGRATFGANFINNVDTDENGHGSHVAGTIGGQTFGVAKNVKLVAVKVLDGDGAGSNSGVLDGMQFVIDDVKAKNITGKAVMNMSLGGSASAAVNRAIEALNTAGIVPVVAAGNENQDAANTSPASAPNAITVGAIDARNDRKASFSNFGKVVDIFAPGVNILSVGIASNTATNTLSGTSMASPHVAGLAAYLMGLEGLNTVKSLTDRMLQLATASGASVQRNTAGTTNLIANNGQL

SEQ ID NO: 207 - protein, 387 aa, Nectria haematococca
MVSNPEAQNIIPNKYIVVFNNDDFDDDAISAKEASFAMAIKKRNLNKRGLNGLNLSTTINSFKMNKWRAMSLDADDLMIKDLYDADEVAYIEADTHVQLNGAIAQVNAPPGLDRLSHAQPNEDTYVFDDSAGEGIVAYVVDTGIKTTHTEFEGRATFGGNFINNVDDDENGHGSHVAGTIAGATFGVAKKAELVAVKVLDVSGGGSNSGVLQGMQFVIDDVEKRGKKGKAVMNMSLGGDFSEAINRAIEALFKAGIVPVVAAGNENVNTALTSPGSAPNAITVGAIDGTTDVRAPFSNFGPDVDIYAPGVQVLSVGIDSNTATASLSGTSMASPHVAGLAAYLMAFQNVQEPSRVVELIKSLAQQSGAKVRNNAADTTDLIANNGNQ

SEQ ID NO: 208 - protein, 425 aa, Cordyceps militaris
MTQLHYRFTSLLLLLGLAIAAPGRIANPPESTAFRLPVSNANVAVTNMIPNRYIVVYNKDFNSTSIDAKEASFAAALRKRNLGKRGLGGNPLSTEVNSLSMNKWRASILDADDDMFMEMYNSEEVSYIEADTRVHTQVVISQINAPPGLARLSHATNGPSNYLFDESAGQGVTVYIVDTGILPSHVEFEGRARSAANFVNQVDTDENGHGSHVAGTIGGATYGVAKRCELLGVKVLDASGGGANSGVLKGLQFVMNDVAERNVSKAVMNMSLGGPRSRAINTAISQLAQAGVIPVVAAGNEDQDASTTSPASAPDAITVGAIDVRNDAKASFSNFGSSVAIFAPGVNILSVGIASNTDSKVLSGTSMASPHVAGLAAYLMGLRGLDEQQPSQVEDLMKNLAGQTGARVRGNEQGTTNRIANNGSR

SEQ ID NO: 209 - protein, 433 aa, Neurospora crassa
MVRFSVAAAFLLSALGVTAAPSGGRHNHQNTQNTGATAGNAAGVPVANSDISNIIPGRYIVVYNNTFGEEAINAHQIKVTSLVAKRNLGKRDAKTGRIMSPSVKAFKMGTWRAMALDADDDMINDINSAQEVEYIEADQYVKLNALTSQNSTTTGLARLSHAGPSKKAAPYIFDSSAGEGITAFVVDTGIRVTHSEYEGRATFAANFVNNVDTDENGHGSHVAGTIAGATFGVAKKAKLVAVKVLDGSGSGSNSGVLQGMQFVADTATSQKLGGKAVLNMSLGGGKSRAINSAINQIAAAGVVPVVAAGNENQDTANTSPGSAPAAITVGAIDQRTDARASFSNFGAGVDIFAPGVNVLSVGIKSDTDTDTLSGTSMASPHVAGLAAYLMALEGLTDVTAVGNRIKELAQKTGAKVTNNVRGTTSLIANNGNL

SEQ ID NO: 210 - protein, 433 aa, Neurospora tetrasperma
MVRFSVAAAFLLSALGVTAAPSGGRHNHQNTQNTGATAGNAAGVPVSNSDISNIIPGRYIVVYNNTFGEEAISAHQIKVTSLVAKRNLGKRDAKTGRIMSPSVKAFKMGTWRAMALDADDDMINDINSAQEVEYIEADQYVKLNALTSQNSTTTGLARLSHAGPSKQAAPYIFDSSAGEGITAFVVDTGIRVTHSEYEGRATFAANFVNNVDTDENGHGSHVAGTIAGATFGVAKKAKLVAVKVLDGSGSGSNSGVLQGMQFVADTATSQKLGGKAVLNMSLGGGKSRAINSAINQIAAAGVVPVVAAGNENQDTANTSPGSAPAAITVGAIDQRTDARASFSNFGAGVDIFAPGVNVLSVGITSDTATDTLSGTSMASPHVAGLAAYLMALEGLTDVTAVGNRIKELAQKTGAKVTNNVRGTTSLIANNGNL

SEQ ID NO: 211 - protein, 411 aa, Verticillium dahliae
MAPISKEVPAGAITGAADFFAKGFSAMLNSESTERVSNSYIVVYNNTFDDDTINFRQTEVMNHIKRRNIGKRGLDGRQLSTEVHALAMNGWRAMTLESDDDMILQIMNEPEVAWVEANARVKLSASVAQMNAPPGLNRLSNAQAGTGNYVFDTTGGEGVTVYVVDTGIRTDHSEFQGRATFGVNTVDNVDNDQNGHGSHVAGTICGQTFGVAKSANVVAVKVLDGTGAGSNAGVLDGLQFIINDVQQKNLRGKAVMNMSLGGPQSAAVNRAVQALFDAGVVPVVAAGNENQDAANTSPASAPKAITVGAIDASNDQKASFSNFGADVDIFAPGVDVLSVGIRSNTATDTLSGTSMASPHVAGLAAYLIALENINTPEAVASRLTELATASGAQVLRNTPGTTNLIANNGQL

SEQ ID NO: 212 - protein, 424 aa, Thielavia terrestris
MAGRLLAALTFALAALGASGLPQPSKAEGFFLGVPISNPEAKNAIPHKYIVVYNSTFSDAEIQAHQDSIIKTISKRNVGKRSPLTGKVLSPHVSTFSMGTWRAMALEADDLMMNEIFAAKEVDYIEQDAYVSIAAQQVQSQATSGLARISHAKPGATTYVFDSSAGQGMTAYVVDTGILVTHSEFEGRATFAANFVGDNQDTDLNGHGSHVAGTIGGKTFGVAKKVNLVAVKVLDANGSGTNSGVIAGMQFVAQNATGSGLSGKAVMNMSVGGSFSRAVNSAINQVAAAGVVPVVAAGNENQNAANTSPASATAAITVGAIDQTDDTRASFSNFGRVVDVFAPGVNVLSVGIRSNTDTQVLSGTSMATPHVAGLAAYLMALEGITGGAQAVSDRIKQLAQATGATVGNDVRGTTTLIANNGNRN

SEQ ID NO: 213 - protein, 511 aa, Magnaporthe oryzae
MAPISSILAPFAALAGLVAALPSNFPGSEKFAGVPVSNINALNVIPQSYIVVYNSTFDSKIIDDSQAMAMAKVAERNLGKRSEDGRDMSTTATTCQIGTWRGLMLDADDQTIMEIMADPAVRYVEADAAMNILIDEEASEMPPPAEITEMQAIARRAEQTETGAPNGLARLSQSEPNPGTSGTYRFEDSAGEGITVYIVDTGIRATHTEFEDRATFGANFIDQVDTDQNGHGSHCAGTIGGKTFGVAKKATLVGVKVLGASGGGSNRGVIQGMQFVANDVTQKNLARKAVMNMSLGGSKSTAVNEAINSMIKAGVVAVVAAGNENDDASKSSPASAPGAITVGAIDQKNDRKASFSNFGTDVDIFAPGVNVLSVDAKSDTGSKTLSGTSMASPHVAGLAAYLMALDPTLTAGGGIETVAGKVDARIKELAKAMGAQVGQAPAGTTTLIANNGKTGNGAGNGTAAAAPADNADAAPATGATRRLRKAQRLTFQRMQQFQRQQIQRQQSQRQQ

SEQ ID NO: 214 - protein, 409 aa, Trichoderma reesei
MASLRRLALYLGALLPAVLAAPAVNYKLPEAVPNKFIVTLKDGASVDTDSHLTWVKDLHRRSLGKRSTAGVEKTYNIDSWNAYAGEFDEETVKQIKANPDVASVEPDYIMWLSDIVEDKRALTTQTGAPWGLGTVSHRTPGSTSYIYDTSAGSGTFAYVVDSGINIAHQQFGGRASLGYNAAGGDHVDTLGHGTHVSGTIGGSTYGVAKQASLISVKVFQGNSASTSVILDGYNWAVNDIVSRNRASKSAINMSLGGPASSTWATAINAAFNKGVLTIVAAGNGDALGNPQPVSSTSPANVPNAITVAALDINWRTASFTNYGAGVDVFAPGVNILSSWIGSNTATNTISGTSMATPHVVGLALYLQALEGLSTPTAVTNRIKALATTGRVTGSLNGSPNTLIFNGNSA

SEQ ID NO: 215 - protein, 409 aa, Trichoderma atroviride
MTSIRRLALYLGALLPAVLAAPAALHKKPEAVPNKFIVTLKEGASIDTDSHLAWVTDIHTRSLTKRSTAGVEKTYNIHTWNAYAGEFDEETIEQIKSNPDVASVEPDYIMHLSDIVEDKRALTTQSGAPWGLGTVSHRTSGSTSYIYDSSAGAGTFAYVVDSGINTSHQQFGGRASLGYNAAGGQHVDTLGHGTHVSGTIGGSTYGVAKQASLISVKVFAGESASTSVILDGYNWAVNDIVSKSRASKSAINMSLGGPASSTWTTAINAAFNQGVLTIVAAGNGDSLGNPQPVSGTSPANVPNAITVAALDINWRTASFTNYGAGVDVFAPGVNILSSWIGSNTATNTISGTSMATPHVVGLALYLQSLEGLTSPTAVTNRIKALATSGRVTGSLNGSPNVIIFNGNSS

SEQ ID NO: 216 - protein, 409 aa, Trichoderma virens
MASIRRLALYLGALLPAVLAAPAGHHKAPEAVPNKFIVTLKEGASIDTDSHLTWVNDLHRRSLTKRNTAGVEKTYNIHTWSAYAGEFDEDTIEQIKASPDVASVEPDYIMYLSDIVEDKRALTTQTGAPWGLGTVSHRTSGSTSYIYDTSAGSGTFAYVVDSGINTSHQQFGGRASLGYNAAGGQHVDTLGHGTHVSGTIGGSTYGVAKQASLISVKVFQGNSASTSVILDGYNWAVNDIVSRNRASKSAINMSLGGPASSAWTTAINAAFNQGVLTIVAAGNGDSLGNPQPVSGTSPANVPNAITVAALDINWRTASFTNYGAGVDVFAPGVNILSSWIGSNTATNTISGTSMATPHVVGLALYLQSLEGLATPTAVTNRIKALATSGRVTGSLNGSPNVLIFNGNSA

SEQ ID NO: 217 - protein, 409 aa, Trichoderma virens
MASIRRLALYLGALLPAVLAAPAGHHKAPEAVPNKFIVTLKEGASIDTDSHLTWVNDLHRRSLTKRNTAGVEKTYNIHTWSAYAGEFDEDTIEQIKASPDVASVEPDYIMYLSDIVEDKRALTTQTGAPWGLGTVSHRTSGSTSYIYDTSAGSGTFAYVVDSGINTSHQQFGGRASLGYNAAGGQHVDTLGHGTHVSGTIGGSTYGVAKQASLISVKVFQGNSASTSVILDGYNWAVNDIVSRNRASKSAINMSLGGPASSAWTTAINAAFNQGVLTIVAAGNGDSLGNPQPVSGTSPANVPNAITVAALDINWRTASFTNYGAGVDVFAPGVNILSSWIGSNTATNTISGTSMATPHVVGLALYLQSLEGLATPTAVTNSPNRIKALATSGRVTGSLNGVLIFNGNSA

SEQ ID NO: 218 - protein, 409 aa, Hypocrea lixii
MASIRRLALYLGALLPAVLAAPAAHHKAPEAVPNKFIVTLKEGASVDTDSHLTWVNDLHRRSLTKRNTAGVEKTYNIHTWNAYAGEFDEETIEQIKSSPDVASVEPDYIMYLSDIVEDKRALTTQTGAPWGLGTVSHRTSGSTSYIYDTSAGSGTYAYVVDSGINTSHQQFGGRATLGYNAAGGQHVDTLGHGTHVSGTIGGSTYGVAKQANLVSVKVFQGDSASTSVILDGYNWAVNDIVSKNRASKSAINMSLGGPASSTWTTAINAAYNQGVLTIVAAGNGDSFGNPQPVSGTSPANVPNAITVAALDINWRTASFTNYGAGVDVFAPGVNILSSWIGSNTATNTISGTSMATPHVVGLALYLQSLEGLSTPAAVTNRIKALATSGRVTGSLNGSPNVIIFNGNSA

SEQ ID NO: 219 - protein, 409 aa, Trichoderma hamatum
MTSIRRLALYLGALLPAVLAAPAALHKKPEAAPNKFIVTLKEGASIDTDSHLAWVNDIHRRSLTKRSTAGVEKTYNIHTWSAYAGEFDAETIEQIKSSPDVASVEPDYIMYLSDIVEDKRALTTQSGAPWGLGTVSHRTSGSTSYIYDSSAGSGTFAYVVDSGINTSHQQFGGRASLGYNAAGGQHVDTLGHGTHVSGTIGGSTYGVAKQASLISVKVFAGESATTSVILDGYNWAVNDIVSRNRASKSAINMSLGGPASSTWTTAINAAFNQGVLTIVAAGNGDSFGNPQPVSGTSPANVPNAITVAALDINWRTASFTNYGAGVDVFAPGVNILSSWIGSNTATNTISGTSMATPHVVGLALYLQSLEGLTTPTAVTNRIKALATAGRITGSLNGSPNTLIFNGNSA

SEQ ID NO: 220 - protein, 403 aa, Aspergillus fumigatus
MLSIKRTLLLLGAVLPAVFGAPVQETRRAAQKIPGKYIVTFKPGTDTATIESHTLWATDLHKRNLERRDTTSGEPPVGIEKSYKIKDFAAYAGSFDDATIEEIRKRGDVAHVEEDQIWYLDALTTQKGAPWGLGSISHKGQASTDYIYDTSAGAGTYAYVVDSGINVNHVEFESRASLAYNAAGGSHVDSIGHGTHVAGTIGGKTYGVAKKTNLLSVKVFQGESSSTSIILDGFNWAVNDIVSKGRTKKAAINMSLGGGYSYAFNNAVENAFDEGVLSVVAAGNENSDASNTSPASAPNALTVAAINKSNARASFSNYGSVVDIFAPGQDILSAWIGSTTATNTISGTSMATPHIVGLSVYLMGLENLSGPAAVTARIKELATNGVVTNVKGSPNKLAYNGNA

SEQ ID NO: 221 - protein, 403 aa, Aspergillus terreus
MQSIKRTLLLLGAVLPAVLAGPIFPHRRAPTTIPGKYIVTFKSDVDQAAIDKHTAWATDIHKRNLQRRDSSEEDLPIGIERNFKINKFAAYSGSFDEDTIAQIRQSDEVAAVEEDQVWHLFDLTTQSDAPWGLGSISHKGQPSTDYIYDTNGGEGTYAYVVDTGINVDHEEFEGRASLAYNAAGGQHVDGVGHGTHVSGTIGGKTYGVAKKANLLSVKVFVGESSSTSIILDGFNWAANDIVSKKRTGKAAINMSLGGGYSKAFNDAVENAFNEGVLSIVAAGNENTDASSTSPASAPDAFTVAAINVNNTRAYFSNYGSVVDIFAPGQNILSAWIGSNTATNTISGTSMATPHIVGLSIYLMSLEDLSSPKAVSDRIKELATRGVVSNVAGSPNLLAYNGNA

SEQ ID NO: 222 - protein, 403 aa, Aspergillus oryzae
MQSIKRTLLLLGAILPAVLGAPVQETRRAAEKLPGKYIVTFKPGIDEAKIQEHTTWATNIHQRSLERRGATGGDLPVGIERNYKINKFAAYAGSFDDATIEEIRKNEDVAYVEEDQIYYLDGLTTQKSAPWGLGSISHKGQQSTDYIYDTSAGEGTYAYVVDSGVNVDHEEFEGRASKAYNAAGGQHVDSIGHGTHVSGTIAGKTYGIAKKASILSVKVFQGESSSTSVILDGFNWAANDIVSKKRTSKAAINMSLGGGYSKAFNDAVENAFEQGVLSVVAAGNENSDAGQTSPASAPDAITVAAIQKSNNRASFSNFGKVVDVFAPGQDILSAWIGSSSATNTISGTSMATPHIVGLSLYLAALENLDGPAAVTKRIKELATKDVVKDVKGSPNLLAYNGNA

SEQ ID NO: 223 - protein, 416 aa, Aspergillus niger
MAFLKRILPLLALILPAVFSATEQVPHPTIQTIPGKYIVTFKSGIDNAKIESHAAWVTELHRRSLEGRSTTEDDLPAGIERTYRIANFAGYAGSFDEKTIEEIRKHNHVAYVEQDQVWYLDTLVTERRAPWGLGSISHRGASSTDYIYDDSAGEGTYAYVVDTGILATHNEFGGRASLAYNAAGGEHVDGVGHGTHVAGTIGGKTYGVSKNAHLLSVKVFVGESSSTSVILDGFNWAANDIVSKNRTSKAAINMSLGGGYSYAFNNAVENAFDEGVLSCVAAGNENRDAARTSPASAPDAITVAAINRSNARASFSNYGSVVDIFAPGEQVLSAWTGSNSATNTISGTSMATPHVTGLILYLMGLRDLATPAAATTELKRLATRNAVTNVAGSPNLLAYNGNSGVSKGGSDDGDED

SEQ ID NO: 224 - protein, 411 aa, Glomerella graminicola
MANLRRLALAIAALLPAVLAAPAALNRRDEPAAAPGKYIITLKEDAAVNVDSHLNWVADVHRRSLGKRNTAGVENKFNISTWNAYSGEFDEATIEAIKASPEVAVVEPDYYMYLSDFEVDERALTTQTGAPWGLGSISHKTKGSTQYVYDTSAGANTYAYVVDSGVISTHTQFGGRVTLGFNAYSGVHTDTLGHGTHVAGTIGGSTYGVAKQTNIISVKVFQGASGTTSSILSGFNWAVNDITSKGRAARSVINMSLGGPSSTTWNTAINAAYSQGVLSVVAAGNGDSLGNPLPVSSQSPANVPNALTVAAIDSNWAPAYFTNYGPGVDIFAPGVSILSAWIGGNSATNTISGTSMATPHVTGLALYLQALENIATPAALTARIKALGTSGRITGTLSGSPNLVAYNGNGA

SEQ ID NO: 225 - protein, 411 aa, Gibberella zeae
MTSFRRLALALGALLPAVLAAPTEKRQELTAAPDKYIITLKPEATENKIEAHLNWVSDVHRRSLNKRDTSGVEKKFNISSWNAYSGEFDKATIDEIKKSPEVAFVEPDYTVYLDFETELTDRALTTQSGAPWGLASISRRTSGGSTYTYDTTAGSGSYGYVVDSGINVNHRDFGGRASLGYNAAGGAHVDTLGHGTHVAGTIASSTYGVAKAANVISVKVFTGNSASTSTILAGFNWAVNDITSKGRAGRSVINMSLGGPSAQTWTTAINAAYNSGVLSVVAAGNGDDLGRPLPVSGQSPANVPNALTVAAIDSSWRTASFTNYGAGVDVFAPGVGILSTWYTSNTATNSISGTSMACPHVAGLALYLQVLEGLSTPAAVTNRIKALATTGRVTGTLNGSPNLIAFNGAST

SEQ ID NO: 226 - protein, 414 aa, Fusarium oxysporum
MTSIRRLALALGALLPAVLAAPADILSKRQAVPDKYIITLKPDASDSSVAAHLNWVGDVHRRSLNKRDTSGVEKTFNISSWSAYSGEFDKSTIAEIKKSPEVAFVEPDYTMYLSYEESEPELADRALTTQSGAPWGLGTISHRTSGSTSYIYDTTAGQGSYAYVVDSGVQVSHTNFGGRASLGYNAVGGAHEDTLGHGTHVAGTIAGTTYGVAKRANIISVKVFAGREGSTSTILAGFNWAVNDITSKSRAGRSVINLSLGGPASQTWTSAINAAYNSGVLSVVAAGNGDDAGRPLPVSGQSPANAPNALTVAAIDSSWRPASFTNYGAGVDVFGPGVNILSTWIGSNSATNTISGTSMACPHVAGLALYLQVLEGLSTPASVTNRIKSLATTGRITGTLSGSPNSVAYNGNGA

SEQ ID NO: 227 - protein, 415 aa, Nectria haematococca
MASIRRLALFLGALLPAALAAPVDGPVRRQETAIPNKYIITLKPEASDSKISAHLDWVGDVHRRSLSKRDTAGVEETYNISNWNAYAGEFDEATIEEIKSSPEVAFVEPDFEAYLWVEESSELSDRALTTQTGATWGLGTISHRTSGSTSYIYDTSAGSGSYAYVVDSGVQVGHSQFGTRASLGFNAFSGAHTDTLGHGTHVAGTIAGSTYGVAKQANIISVKVFQGNQGSTSTILSGFNWAVNDITSKGRQGRSVINLSLGGESSQTWISAINAAYNSGVLSVVAAGNGDINGNPLPVSSQSPANAPNALTVGAIDSSWRPASFTNYGAGVDIHAPGVSVLSSYIGSNTATRSLSGTSMACPHVAGLALYLQVLEGLSTPAAVTNRIKALGTSGRITGTLNGSPNLVAYNGNGA

SEQ ID NO: 228 - protein, 403 aa, Neosartorya fischeri
MLSIKRTLLLLGAVLPAVFGAPVQETRRAAQKIPGKYIVTFKPGTDAATIESHTLWATDLHKRNLERRDATSGEPPIGIEKNYKIKDFAAYAGSFDDTTIEEIRKSADVAHVEEDQIWYIDALTTQKGAPWGLGSISHKGQASTDYIYDTSAGAGTYAYVVDTGINVNHVEFEGRASLAYNAAGGSHVDSVGHGTHVAGTIGGKTYGVAKKTNLLSVKVFQGESSSTSIILDGFNWAANDIVSKGRTRKAAINMSLGGGYSYAFNNAVENAFDEGVLSVVAAGNENTDASNTSPASAPNALTVAAINRSNARASFSNYGSVVDIFAPGQDILSAWIGSNTATNTISGTSMATPHIVGLSVYLMGLESLSGPAAVTSRIKQLATNGVVTNAQGSPNKLAYNGNA

SEQ ID NO: 229 - protein, 393 aa, Verticillium albo-atrum
MVNFRNVLLGLLPFAAAAPVAPGSPDVANKYIVTLKSGISTDNVASHLNWVSDVHKRSLGRRDLAGVEKTYDIKNFHAYAGTFDESVVAELKNNPDVAAVEPDQIYTLSAYTTQSSAPWGLASISSRTSGATSYRYDNSAGAGTFAYVVDSGILTTHTNFGGRAIRGYNAAGGEWVDSIGHGTHVAGTIGSTTYGVAKAATLIDVKVFVGRTSSTSIILDGFNWAVNDIVSKNRASRSVINLSLGGPTSTAWTSAINAAYSSGILSVAAAGNENVSASTRSPANAPNALTVGAINSAWAEDTSYSNFGPAIDILAPGTNVLSLGYTSNTSTRTLTGTSMAAPHVAGLALYLAAFENINTPAALRNRIVALGTSGRATGIRGGSPNLIAYNGNA

SEQ ID NO: 230 - protein, 401 aa, Glomerella graminicola
MVGFKRFAMLAAAACAMAAPTRREEATEVTAQTIEGSYIITLKNTVSVEGLTSHLSWINDVHSRSLDKRQFPGAERTFSFNSFQAYSGKFDDATIDIIKSSPEVASVERDQLWTLSAIATQTGAPWGLGTVSRRTSGSTQYLYDTNAGSGTFAYVVDSGINVGHTNFGGRATLGYNAAGGAHTDTLGHGTHVAGTIGSTTYGVAKLTSLISVKVFVGNSASTSVILAGYNWAVNDITTKGRASKSVINMSLGGPSSTAWTTAINAAYSAGVITVVAAGNEAQNAANVSPANAPNAITVGAITSTWAIASYSNYGTSLDLFAPGSSILSTWIGSTTATNSISGTSMASPHVAGLVNYLQSVENVGTPAAVVARIKALATTGRVTGNLRSSPNLIAYNGAGGA

SEQ ID NO: 231 - protein, 555 aa, Trichoderma reesei
MRACLLFLGITALATAIPALKPPHGSPDRAHTTQLAKVSIALQPECRELLEQALHHLSDPSSPRYGRYLGREEAKALLRPRREATAAVKRWLARAGVPAHDVLTDGQFIHVRTLAEKAQALLGFEYNSTLGSQTIAISTLPGKIRKHVMTVQYVPLWTEADWEECKTIITPSCLKRLYHVDSYRAKYESSSLFGIVGFSGQAAQHDELDKFLHDFAPYSTNANFSIESVNGGQSPQGMNEPASEANGDVQYAVAMGYHVPVRYYAVGGENHDIIPDLDLVDTTEEYLEPFLEFASHLLDLDDDELPRVVSISYGANEQLFPRSYAHQVCDMFGQLGARGVSIVVAAGDLGPGVSCQSNDGSARPKFIPSFPATCPYVTSVGSTRGIMPEVAASFSSGGFSDYFARPAWQDRAVGAYLGAHGEEWEGFYNPAGRGFPDVAAQGVNFRFRAHGNESLSSGTSLSSPVFAALIALLNDHRSKSGMPPMGFLNPWIYTVGSHAFTDIIEARSEGCPGQSVEYLASPYIPNAGWSAVPGWDPVTGWGTPLFDRMLNLSLV

SEQ ID NO: 232 - protein, 561 aa, Trichoderma atroviride
MKASRLLFFGVNATVTASPIQQLGESSKAAQVVKLSIALQPESRQLLEQTIYNLSSPSGSRYGQYLGREEAKGLLRPRKSSTDAVKGWLSQAGIRSGHILSDGQFIHVQTDVGSIEALFEVNYNATLGSQTVSVSSLPLRIQGHVMTVQYAPYLTRVRTDWERCKTEITPACLKKLYHVDSYQAKGEERNLVGVAGFDGQAIQYHELGEFLHELVPPPAAFNVSVAFVNGGTNPQGTNFPSSEANQDVQYAVGMAHSVPVRFYATGGENHDIIPDLDLTDPTNEYLEPYLEFANHLLNLPDEQLPSVISISYGANEQLFPKPYAQQVCDMFGQLGTRGVSIIVSSGDFGPGMSCQSNDGTETTKYIPSFPATCPYVTSVGSTEGIGPERAANFSAGGFSDYFARPEWQDEAVGGYLELYGNEWKGYYNAGGRGFPDVAAQGVNYRFWNHGKEDLTTGTSVSTPVFAALVALLNDHRAERGLPRMGFLNPWIYSIGNGAFTDITQSKSIGCQGQSLSGLASPVIPNAGWSAVKGWDPVTGWGTPLFDKMMSLSGGGVDEESH

SEQ ID NO: 233 - protein, 556 aa, Trichoderma virens
MKARLLFLAFNALAMATPMAKPPLGTLKGVQPIQSGKISIALQPECRELLEQTLHYLSDPSSRRYGQYLGREEAKALLRPRQDSTDAVKGWLSQAGIPAIDIQSDGQFINVQVMAEQARALLGTGYNSTLGIQTIPISSLPKDIESHVMTIHYAPTRTEMVTDWEECKSRITPNCLKKLYHVDGYRARHVNKNRFGIVGFTGQAAQYDQLSAFLDDFAPYAANANFSVESVNGGENPQGRNEPTGEANVDIQYAVSMAYDVPVRFYATGGANHDIIPDLDLSDTDNQALEPYLEFASHLLSLDDDELPKVVSISYGANEQLFPRSYAQQVCDMFGQLGTRGVSIVVASGNLGPGVSCQSNDGTKRPKFMPSFPATCPYVTSVGATYGINPEIAVNFSSGGFSDYFIRPQWQDEAIEGYLKLHGREWKGYYNPHGRGFPDVAAQGVNYRFWSHGNEDSASGTSVSSPVFAALIALLNDNRTKNGLPSMGFLNPWIYSIGSHAFTDITESKSLGCSGRSVIGLESPVIPNAGWDAVPGWDPVTGWGTPLFDRLMNLSY

SEQ ID NO: 234 - protein, 592 aa, Metarhizium anisopliae
MSILGLLCVLGSIFLVVSADLVVVEHLDQPPDGWTKLGAANASQLIRLSIALESQGHDVFERTLQEVSDPTHPRYGQYLSRDEAVALVRPRPRSVAAVREWLLSENVTQGQVQERGLFVDAFMTIGTAENLLSTTYGLFRHGKQRAIGALAYSVPAEVRPHITSIQPTTFFEFGNLFKKSPRTSGVGIATARRRNPGVRARSTELQDCENHNTPECLRGLYKMSNDYTKPHRSSLLGVAGFHGQAAQHDQLEKYLDTYAPYAKGANFSVELINNGTNPQGEYPGFEANMDIQIAVSMAFRVPVRFYSTGGEGHEFIPDLDVYDPEKQHLEPWLQFASYLLDLPDRDLPQVMSISYGGNEQAVPKPYARRICQMFGLLALRGVSIILASGDQGPGMSCQSNDGTNSTKFLPAFPAGCPYLTVVGATERNAPERAMNFSSGGFSEYWPRPAWQEAAVSRYLDAHGDRWKGYYNRAGRGFPDVSAQGIGYPFFNHGGNASGGGTSASAPLFASMIAVINDSRMKRGKPPLGFLNPWLYLGASRAFTESEGCKGTSFSGAKAPVIPGAGWDAVEGWDPVTGLGTPLFDELQELAMG

SEQ ID NO: 235 - protein, 603 aa, Nectria haematococca
MMAISLLKTWGFLLLTATAVARPVVVESLDETPEGWEESSSPAPDKPIEFSIGLESEDHFLLERTLSEISDPSHANYGKHLSRDAAKALLHPSRAATDSVKRWLSDAGVPEHHVRDEGQWLHIRTTVGQADSLLSTRFGIFARDDEQVVRTREYSVPIEVRDHITTIQPTTFFPTEKKARAVEDLTALEKREEAVEARAYGNNNDGNHGGNGPIDLQQCKAQLTPACLRKIYKMPLRSYPSAHRKSEYGIVGFLEQNAQFSDLEEFLKRFAPDLKGANFSVSLVNGGLNQQSFNVAQIEANMDIQYAVALADKVPVRFISVGGMNPNLVPDLEQYPEPWLELLQYLLNLPNSNLPKVISLSYGSNEQHISKSYARQVCNMFGQLGTRGVSVIAAAGNTGPGFSCKPNDGKNKKKFLPTFPGACPYVTSVGGTEGNSPEIAWNRSSGGFSEVFSRPWWQEQTVKEYLRKHGNEWKGYYNANGRAYPDVAALAWNHQIMLRGNQTFGGGTSVAAPTFGAMIALINNERFKKGKPPMGFLNPWLYKTGKAGFTDITQGKSVGCTGESYLGLPSPVIPSAGWKAVKGWDPITGWGTPLFDRLQRLAT

SEQ ID NO: 236 - protein, 621 aa, Myceliophthora thermophila
MLRNIFLTAALAAFGQCGSTVFESVPAKPRGWTRLGDASADQPLRLRIALQQPNEDLFERTLYEVSDPSHARYGQHLSRDELSALLAPRAESTAAVLNWLRDAGIPSDKIEEDGEWINLRVTVREASELLDADFGVWAYEGTNVKRVRALQYSVPEEIAPHIRMVAPVVRFGQIRPERSQVFEVVETAPSQVKVAAAIPPQDLDVKACNTSITPECLRALYKVGSYQAEPSKKSLFGVAGYLEQWAKYDQLELFASTYAPYAADANFTSVGVNGGENNQGPSDQGDIEANLDIQYAVALSYKTPITYYITGGRGPLVPDLDQPDPNDVSNEPYLEFFSYLLKLPDSELPQTLTTSYGEDEQSVPRPYAEKVCQMIGQLGARGVSVIFSSGDTGVGSACQTNDGKNTTRFLPIFPGACPYVTSIGATRYVEPEQAAAFSSGGFSDIFKRPAYQEAAVSTYLHKHLGSRWKGLYNPQGRGFPDVSAQGVAYHVFSQDKDIKVSGTSASAPLFAALVSLLNNARLAQGRPPLGFLNPWLYSEKVQKAGALTDIVHGGSSGCTGKDMYSGLPTPYVPYASWNATPGWDPVTGLGTPVFDKLLELSSPGKKLPHIGGGHGHGAGGH

SEQ ID NO: 237 - protein, 613 aa, Gibberella zeae
MLAINLLKTGGFLFSAASVLAVPVVVESLNETPAGWEESDSPSPDEFINLSIGLEPEDHKLLERTIYEVSDPDHHNYGKHLSRESAKALLRPSSAATKSVERWLSEAGVPDHHVRDEGEWLHIQTTVKNAEGMLNTRFSVFARDDRSIVRTREYSVPHEIRRHISSIQPTTLFSSFQHTQSLEETAPTVMKRYVQGEKEPRSTKNGNYGGPGPVDLKKCKTEATPACIRKLYNLPKKYPNAAKGSLYTTVSFQNMTSQRDELQEFLRRYAPDLKGVTFADDFANGGKNTQGDNVPENEGNLNTQYAVSLASRVPIQHLAVGGINTDYISDLDLPPGQGIETWLEFAEHILNLPTKKLPSVISISWGEYEQHLPKKYARQVCNKFGQIGTRGVSIIVPAGNQGVGVACQSNDGKKTKKFLPTWPSACPYVTTVGGTGGNNPEIALSDGEGEPFSTGGGFSDLFPRPEYQEKAVKEYLKKYGKKWQAYYNPKGRAYPDVAAIAAELPVMVRGEVRPATGTSAAAPTFGAIVALLSNERLRKGKPAMGFLNPWIYKKGYKGFTDIVDGRNYGCQGFSLQDTLAPEIPGAGWEAVKGWDPVSGFGTPLYDKLEKLAL

SEQ ID NO: 238 - protein, 610 aa, Thielavia terrestris
MLQQLFVTAALAALGQCGLTVLESLPAQPRGWTRVGDASPDHTLKLRIALHQPNEALFERTLYEISDPFHAKYGQHLSRDELSALMAPRAESTSAVVSWLRDAGIASSNIEEDGEWIHVKMTVREASALLDADFGLWAHDGTNVKRVRALKYSVPDEVVEHVKMVAPIVRFGQMRPQRSQIFEVVDSKTPEPKAAAIPPQTLNATACNATITPECLRALYNVGSYQADPSEHSLFGVSGYLEEWAKYDQLELFTHTYAPYAAESNFTAVLVNGGVNNQGPSTQDDIEANLDIQYAVAMSYKTPINYYSTGGRGPVVPDLTEPDPNDSSNEPYLDFFGYLLKLPDSELPQTLSTSYGEDEQSVPRAFAEKVCQMIGQLGARGVSVIFSSGDSGVGSGCQTNDGKNTTRFLPIFPAACPYVTSVGATRYVNPEYAVSFSSGGFSDIFPRPLYQELAVTSYLTQHLGKRWAGLYNPGGRGFPDVAAQGVRYHVFSGGRDVLVSGTSASAPLFASLVSLLNNARLARGLPPLGFLNPWLYAVGWAGLTDIQHGGSTGCTANDSSSGVPTPYVPYASWNATPGWDPVTGLGTPNLEKLLDLSTPGWRLPRIGDWK

SEQ ID NO: 239 - protein, 623 aa, Magnaporthe oryzae
MEPTEPYPYPRGPTPPFVIAYAALATVLPLSASAASNVVVESLPAVPEGWEKIQDADPDSKIRLKVALRQPNLALFEREMYAVSSPLSARYGKHLKREEVRDLMKPDPASTSTVMQWLENAGIPSQAIHEDSDWINIVTSVRNASALLKADFGVYGHANSDLKKIRALEYSVPDNVRDHITMVAPIIRFGEIKPKRSIVKSVEDSKGSIQAAEVPTGQLDVAACNKTITPECLRALYQIGDYKATGSPKSRFGIAGYLEEYARYSELEKFQEVYAPYTLGSNFSVVTINGGLNDQSSTADSVEANLDMQYGVALGYNTNIVYYSTGGRGPLVPDLDQPNGNDSSNEPYLDFLEYMKNLPDDELPQTLTTSYGENEQSVPREFAVKVCNMFGELGARGVSIFFSSGDEGPGSACQSNDGKNTTRFDPAFPAACPYVTAVGGTRYVAPETGAALAGGGFSDIWPQPEWQKTAVEKYLSILGDKWKGLYNPSGRAYPDIAGQAYSYHVFDSGKDVLVAGTSASSPSVAAIFALLNDARLAANQPPMGWINPWLYEIGLKGLTDITVGGSRGCTGKSIYSGLPAPKVPFASWNATEGWDPVTGLGTPLFNKLLELSTPGAQAQKIAN

SEQ ID NO: 240 - protein, 388 aa, Trichoderma reesei
MAWLKKLALVLLAIVPYATASPALSPRSREILSLEDLESEDKYVIGLKQGLSPTDLKKHLLRVSAVQYRNKNSTFEGGTGVKRTYAIGDYRAYTAVLDRDTVREIWNDTLEKPPWGLATLSNKKPHGFLYRYDKSAGEGTFAYVLDTGINSKHVDFEGRAYMGFSPPKTEPTDINGHGTHVAGIIGGKTFGVAKKTQLIGVKVFLDDEATTSTLMEGLEWAVNDITTKGRQGRSVINMSLGGPYSQALNDAIDHIADMGILPVAAAGNKGIPATFISPASADKAMTVGAINSDWQETNFSNFGPQVNILAPGEDVLSAYVSTNTATRVLSGTSMAAPHVAGLALYLMALEEFDSTQKLTDRILQLGMKNKVVNLMTDSPNLIIHNNVK

SEQ ID NO: 241 - protein, 411 aa, Trichoderma atroviride
MAWFKHVALLLIAALPRITALPVNDANDANDANENSISAEGRYIVTLQNNIPMPEVRNHMSRVAAIQYRNSGNHKLPHTGIEKAYAIGEFRAYVGAFDLDTLQMIRNDTRVAEIEPDTVVSIREETSYKAASQSNAPWGLATLSSKRRNTGTYHYDTSAGNGTFAYVLDSGINVNHIEFEGRASNGYNAVDGDFTDIQGHGTHCAGIIGSKSYGVAKKAQLIAVKTFRNQETLMSTVMDAYQWSANDIRTKNRVGLAVINMSLGGSYSRAMNHAVESAFDMGILTIVAAGNEGRPARLVSPASAANAFTVGAIDADWHQWEHSNFGPEVNIFAPGVNIESTYISTDMATRKLSGTSMAAPHVAGLALYLCALEKIDNPITLRERILDLGTRGRIHKLRGESPNLIAHNNLH

SEQ ID NO: 242 - protein, 407 aa, Trichoderma virens
MAWFKKLALLLITVSPCVTAYPFNKTGRRLALNLDALEPEAKYIVTLQKDLTPTQFKNHIAKVNGTYYRSSQDNKQSSPSGLERTYAIGGYRAYSGTFDKDTIASLWSDAVVAEIELDDYFTVQKLVTQRHAPWGLAALSSKKPGSESYRYDKSAGNGTFAYVIDTGINTKHVEFGGRASVGYSVIADDFSDNSGHGTHVSGIIGGKTFGVAKQTEIIGVKVFLNNGGENSDVIDGLQWAVRDILAKGRQSRSVINMSLGGPYSYALNHAVDAAFEMGILVVVAAGNDAEPARYSSPASSSQALTVGAIDIQWRRCGFSNFGPEVNIEAPGEDIESAFIATDNATAILDGTSMATPHITGLALYLAALEKTKTAKELRDKVLEVAIKDKAKDLTLETPNLIAHNGAR

SEQ ID NO: 243 - DNA, 57 bp, Artificial Sequence
  Synthetic Construct
gtaacgccagggttttcccagtcacgacggtttaaacgtattgcgatgagcagcaga

SEQ ID NO: 244 - DNA, 43 bp, Artificial Sequence
  Synthetic Construct
atccacttaacgttactgaaatctggtctcctaacccaccaag

SEQ ID NO: 245 - DNA, 43 bp, Artificial Sequence
  Synthetic Construct
ctccttcaatatcatcttctgtctgtgaaatgaggtcccttcc

SEQ ID NO: 246 - DNA, 57 bp, Artificial Sequence
  Synthetic Construct
gcggataacaatttcacacaggaaacagcgtttaaaccaaacgcagcagaaaccata

SEQ ID NO: 247 - DNA, 51 bp, Artificial Sequence
  Synthetic Construct
gatttcagtaacgttaagtggatgcggccgcgacagaagatgatattgaag

SEQ ID NO: 248 - DNA, 50 bp, Artificial Sequence
  Synthetic Construct
gacagaagatgatattgaaggaggcggccgcttaagtggatcccggtgac

SEQ ID NO: 249 - DNA, 68 bp, Artificial Sequence
  Synthetic Construct
ggtgggttaggagaccagatttcagtaacgttaagtggatgcggccgcctagcatcgactactgctgc

SEQ ID NO: 250 - DNA, 46 bp, Artificial Sequence
  Synthetic Construct
gcagcagtagtcgatgctaggcgcgccatgcaaagatacacatcaa

SEQ ID NO: 251 - DNA, 46 bp, Artificial Sequence
  Synthetic Construct
ttgatgtgtatctttgcatggcgcgcctagcatcgactactgctgc

SEQ ID NO: 252 - DNA, 68 bp, Artificial Sequence
  Synthetic Construct
agggacctcatttcacagacagaagatgatattgaaggaggcggccgcggctgatgaggctgagagag

SEQ ID NO: 253 - DNA, 20 bp, Artificial Sequence
  Synthetic Construct
tcgctgtaacgaacttctgt

SEQ ID NO: 254 - DNA, 20 bp, Artificial Sequence
  Synthetic Construct
cattgttgacctccactagc

SEQ ID NO: 255 - DNA, 20 bp, Artificial Sequence
  Synthetic Construct
gctgctgatcggacattttt

SEQ ID NO: 256 - DNA, 18 bp, Artificial Sequence
  Synthetic Construct
gtttctggcagctggact

SEQ ID NO: 257 - DNA, 20 bp, Artificial Sequence
  Synthetic Construct
tcgctgtaacgaacttctgt

SEQ ID NO: 258 - DNA, 20 bp, Artificial Sequence
  Synthetic Construct
tgcgtcgccgtctcgctcct

SEQ ID NO: 259 - DNA, 20 bp, Artificial Sequence
  Synthetic Construct
cgacgatctacagccatctg

SEQ ID NO: 260 - DNA, 20 bp, Artificial Sequence
  Synthetic Construct
acccaaagcgtccttcatta

SEQ ID NO: 261 - DNA, 57 bp, Artificial Sequence
  Synthetic Construct
gtaacgccagggttttcccagtcacgacggtttaaacttcagttgtggcatctcagc

SEQ ID NO: 262 - DNA, 68 bp, Artificial Sequence
  Synthetic Construct
gccaagcccaaaaagtgctccttcaatatcatcttctgtcgcggccgcgggaagcaagtttcgaagtg

SEQ ID NO: 263 - DNA, 68 bp, Artificial Sequence
  Synthetic Construct
cccgtcaccgagatctgatccgtcaccgggatccacttaagcggccgcaatggatgaggtgtggcttc

SEQ ID NO: 264 - DNA, 57 bp, Artificial Sequence
  Synthetic Construct
gcggataacaatttcacacaggaaacagcgtttaaactcctcaccgaagagcaagtc

SEQ ID NO: 265 - DNA, 57 bp, Artificial Sequence; identical to SEQ ID NO: 261
  Synthetic Construct

SEQ ID NO: 266 - DNA, 20 bp, Artificial Sequence
  Synthetic Construct
cattgttgacctccactagc

SEQ ID NO: 267 - DNA, 19 bp, Artificial Sequence
  Synthetic Construct
cgtcaccgagatctgatcc

SEQ ID NO: 268 - DNA, 57 bp, Artificial Sequence; identical to SEQ ID NO: 264
  Synthetic Construct

SEQ ID NO: 269 - DNA, 20 bp, Artificial Sequence
  Synthetic Construct
gacgtggtacgacaacatcg

SEQ ID NO: 270 - DNA, 20 bp, Artificial Sequence
  Synthetic Construct
tatcaaggtaccggggacag

SEQ ID NO: 271 - DNA, 67 bp, Artificial Sequence
  Synthetic Construct
gattaagttgggtaacgccagggttttcccagtcacgacggtttaaacacctcatgagggactatgg

SEQ ID NO: 272 - DNA, 69 bp, Artificial Sequence
  Synthetic Construct
gcgctggcaacgagagcagagcagcagtagtcgatgctaggcggccgccaagaagaggcagagggtaat

SEQ ID NO: 273 - DNA, 68 bp, Artificial Sequence
  Synthetic Construct
caaccagccgcagcctcagcctctctcagcctcatcagccgcggccgcctatacatactgatgataca

SEQ ID NO: 274 - DNA, 68 bp, Artificial Sequence
  Synthetic Construct
tggaattgtgagcggataacaatttcacacaggaaacagcgtttaaacgccccatgtatggactctac

SEQ ID NO: 275 - DNA, 22 bp, Artificial Sequence
  Synthetic Construct
ctcagaaaggttgtagttgtga

SEQ ID NO: 276 - DNA, 20 bp, Artificial Sequence
  Synthetic Construct
ccatgagcttgaacaggtaa

SEQ ID NO: 277 - DNA, 22 bp, Artificial Sequence
  Synthetic Construct
gatgttgtgttttcagtctgca

SEQ ID NO: 278 - DNA, 19 bp, Artificial Sequence
  Synthetic Construct
catcctcaaggcctcagac

SEQ ID NO: 279 - DNA, 19 bp, Artificial Sequence
  Synthetic Construct
atgttcatcgctggcgtcg

SEQ ID NO: 280 - DNA, 21 bp, Artificial Sequence
  Synthetic Construct
ctaaacgtaagagcaggtcaa

SEQ ID NO: 281 - DNA, 67 bp, Artificial Sequence
  Synthetic Construct
gattaagttgggtaacgccagggttttcccagtcacgacggtttaaacgctactacgcgagcaagtg

SEQ ID NO: 282 - DNA, 66 bp, Artificial Sequence
  Synthetic Construct
ggaactgtcggcgattgggagaatttcgtgcgatcgcggcggccgccggatgaagatgtgcagttg

SEQ ID NO: 283 - DNA, 69 bp, Artificial Sequence
  Synthetic Construct
agggaacatatcaccctcgggcatttttcatttggtaggcggccgctaagatatcttcaagcttatgcg

SEQ ID NO: 284 - DNA, 20 bp, Artificial Sequence
  Synthetic Construct
cggatgaagatgtgcagttg

SEQ ID NO: 285 - DNA, 61 bp, Artificial Sequence
  Synthetic Construct
tgtctcacttccacccatctcaactgcacatcttcatccgagcaacaacatgaggttcgaa

SEQ ID NO: 286 - DNA, 69 bp, Artificial Sequence
  Synthetic Construct
cctatgttgtgtggaattgtgagcggataacaatttcacagtttaaacacaacgcatgtccagcttttg

SEQ ID NO: 287 - DNA, 19 bp, Artificial Sequence
  Synthetic Construct
gcttggcatcacggaagct

SEQ ID NO: 288 - DNA, 20 bp, Artificial Sequence
  Synthetic Construct
ccatgagcttgaacaggtaa

SEQ ID NO: 289 - DNA, 21 bp, Artificial Sequence
  Synthetic Construct
ttgacaagaaaggtccggttg

SEQ ID NO: 290 - DNA, 19 bp, Artificial Sequence
  Synthetic Construct
catcctcaaggcctcagac

SEQ ID NO: 291 - DNA, 20 bp, Artificial Sequence
  Synthetic Construct
atggatgctatccgagccag

SEQ ID NO: 292 - DNA, 22 bp, Artificial Sequence
  Synthetic Construct
ctattcatactcaacagtcaca

SEQ ID NO: 293 - DNA, 58 bp, Artificial Sequence
  Synthetic Construct
gtaacgccagggttttcccagtcacgacggtttaaactgctgttgctgtttgttgatg

SEQ ID NO: 294 - DNA, 69 bp, Artificial Sequence
  Synthetic Construct
cccgtcaccgagatctgatccgtcaccgggatccacttaagcggccgcctgtggtgagatctccagacg

SEQ ID NO: 295 - DNA, 69 bp, Artificial Sequence
  Synthetic Construct
gccaagcccaaaaagtgctccttcaatatcatcttctgtcgcggccgcactgtgcccaacaataagcag

SEQ ID NO: 296 - DNA, 55 bp, Artificial Sequence
  Synthetic Construct
gcggataacaatttcacacaggaaacagcgtttaaacccaaggcgctggctgtta

SEQ ID NO: 297 - DNA, 20 bp, Artificial Sequence
  Synthetic Construct
gatcgacaaaggttccagcg

SEQ ID NO: 298 - DNA, 20 bp, Artificial Sequence
  Synthetic Construct
aattgtatcattccgaggct

SEQ ID NO: 299 - DNA, 19 bp, Artificial Sequence
  Synthetic Construct
ctgtttggccctcgaaact

SEQ ID NO: 300 - DNA, 20 bp, Artificial Sequence
  Synthetic Construct
cattgttgacctccactagc

SEQ ID NO: 301 - DNA, 20 bp, Artificial Sequence
  Synthetic Construct
ttcgccatccaaatttcttc

SEQ ID NO: 302 - DNA, 18 bp, Artificial Sequence
  Synthetic Construct
gtttctggcagctggact

SEQ ID NO: 303 - DNA, 19 bp, Artificial Sequence
  Synthetic Construct
ctgtttggccctcgaaact

SEQ ID NO: 304 - DNA, 20 bp, Artificial Sequence
  Synthetic Construct
tgcgtcgccgtctcgctcct

SEQ ID NO: 305 - DNA, 20 bp, Artificial Sequence
  Synthetic Construct
ttcgccatccaaatttcttc

SEQ ID NO: 306 - DNA, 19 bp, Artificial Sequence
  Synthetic Construct
catcctcaaggcctcagac

SEQ ID NO: 307 - DNA, 20 bp, Artificial Sequence
  Synthetic Construct
cccaagtcgtctcagctctc

SEQ ID NO: 308 - DNA, 21 bp, Artificial Sequence
  Synthetic Construct
tcgaaggcttcagtgaggtaa

SEQ ID NO: 309 - DNA, 57 bp, Artificial Sequence
  Synthetic Construct
gtaacgccagggttttcccagtcacgacggtttaaacatctcggagtgatgcttcct

SEQ ID NO: 310 - DNA, 68 bp, Artificial Sequence
  Synthetic Construct
gcgctggcaacgagagcagagcagcagtagtcgatgctaggcggccgcatcagacgaaaccagacgag

SEQ ID NO: 311 - DNA, 68 bp, Artificial Sequence
  Synthetic Construct
caaccagccgcagcctcagcctctctcagcctcatcagccgcggccgcgcgaatcgagttgatgattc

SEQ ID NO: 312 - DNA, 57 bp, Artificial Sequence
  Synthetic Construct
gcggataacaatttcacacaggaaacagcgtttaaacctggttgggatctgaccact

SEQ ID NO: 313 - DNA, 20 bp, Artificial Sequence
  Synthetic Construct
gcagacaaacagagcaacga

SEQ ID NO: 314 - DNA, 20 bp, Artificial Sequence
  Synthetic Construct
ccatgagcttgaacaggtaa

SEQ ID NO: 315 - DNA, 20 bp, Artificial Sequence
  Synthetic Construct
tagagggtgtcgatggaagc

SEQ ID NO: 316 - DNA, 19 bp, Artificial Sequence
  Synthetic Construct
catcctcaaggcctcagac

SEQ ID NO: 317 - DNA, 20 bp, Artificial Sequence
  Synthetic Construct
ggtctcttctttgccagcac

SEQ ID NO: 318 - DNA, 20 bp, Artificial Sequence
  Synthetic Construct
tgtcgctgaactgaatttgc

SEQ ID NO: 319 - DNA, 67 bp, Artificial Sequence
  Synthetic Construct
gattaagttgggtaacgccagggttttcccagtcacgacggtttaaacgcagtctatcccatccctg

SEQ ID NO: 320 - DNA, 68 bp, Artificial Sequence
  Synthetic Construct
gcgctggcaacgagagcagagcagcagtagtcgatgctaggcggccgcgcggatgatgaaggaagaag

SEQ ID NO: 321 - DNA, 68 bp, Artificial Sequence
  Synthetic Construct
caaccagccgcagcctcagcctctctcagcctcatcagccgcggccgcaacagctgttcgcacgcgtg

SEQ ID NO: 322 - DNA, 66 bp, Artificial Sequence
  Synthetic Construct
tggaattgtgagcggataacaatttcacacaggaaacagcgtttaaacggctgggcattggggccg

SEQ ID NO: 323 - DNA, 68 bp, Artificial Sequence
  Synthetic Construct
gattaagttgggtaacgccagggttttcccagtcacgacggtttaaacaaacaaggcacaaaggcctg

SEQ ID NO: 324 - DNA, 67 bp, Artificial Sequence
  Synthetic Construct
gcgctggcaacgagagcagagcagcagtagtcgatgctaggcggccgcatccaaggatgaggagaac

SEQ ID NO: 325 - DNA, 71 bp, Artificial Sequence
  Synthetic Construct
caaccagccgcagcctcagcctctctcagcctcatcagccgcggccgcacctaatggtttcttcgtttttc

SEQ ID NO: 326 - DNA, 68 bp, Artificial Sequence
  Synthetic Construct
tggaattgtgagcggataacaatttcacacaggaaacagcgtttaaaccggtccgaagggtgttttgg

SEQ ID NO: 327 - DNA, 17 bp, Artificial Sequence
  Synthetic Construct
gatgcaccgctgcggcc

SEQ ID NO: 328 - DNA, 20 bp, Artificial Sequence
  Synthetic Construct
ccatgagcttgaacaggtaa

SEQ ID NO: 329 - DNA, 19 bp, Artificial Sequence
  Synthetic Construct
catcctcaaggcctcagac

SEQ ID NO: 330 - DNA, 18 bp, Artificial Sequence
  Synthetic Construct
ggcgttgctccccatgcg

SEQ ID NO: 331 - DNA, 18 bp, Artificial Sequence
  Synthetic Construct
atgcggtccgttgtcgcc

SEQ ID NO: 332 - DNA, 20 bp, Artificial Sequence
  Synthetic Construct
ttactcggagagctcagaga

SEQ ID NO: 333 - DNA, 20 bp, Artificial Sequence
  Synthetic Construct
gtgaatgggtggcaacatga

SEQ ID NO: 334 - DNA, 20 bp, Artificial Sequence
  Synthetic Construct
ccatgagcttgaacaggtaa

SEQ ID NO: 335 - DNA, 19 bp, Artificial Sequence
  Synthetic Construct
catcctcaaggcctcagac

SEQ ID NO: 336 - DNA, 21 bp, Artificial Sequence
  Synthetic Construct
catcaagttgaccaccattgt

SEQ ID NO: 337 - DNA, 19 bp, Artificial Sequence
  Synthetic Construct
atgcggttgtccgtcctcc

SEQ ID NO: 338 - DNA, 20 bp, Artificial Sequence
  Synthetic Construct
ttaaccggaagggttgccgt

SEQ ID NO: 339 - DNA, 19 bp, Artificial Sequence
  Synthetic Construct
ctgtttggccctcgaaact

SEQ ID NO: 340 - DNA, 20 bp, Artificial Sequence
  Synthetic Construct
ccatgagcttgaacaggtaa

SEQ ID NO: 341 - DNA, 20 bp, Artificial Sequence
  Synthetic Construct
ttcgccatccaaatttcttc

SEQ ID NO: 342 - DNA, 19 bp, Artificial Sequence
  Synthetic Construct
catcctcaaggcctcagac

SEQ ID NO: 343 - DNA, 20 bp, Artificial Sequence
  Synthetic Construct
gcagacaaacagagcaacga

SEQ ID NO: 344 - DNA, 20 bp, Artificial Sequence
  Synthetic Construct
ccatgagcttgaacaggtaa

SEQ ID NO: 345 - DNA, 20 bp, Artificial Sequence
  Synthetic Construct
tagagggtgtcgatggaagc

SEQ ID NO: 346 - DNA, 19 bp, Artificial Sequence
  Synthetic Construct
catcctcaaggcctcagac

SEQ ID NO: 347 - DNA, 20 bp, Artificial Sequence
  Synthetic Construct
ggtctcttctttgccagcac

SEQ ID NO: 348 - DNA, 20 bp, Artificial Sequence
  Synthetic Construct
tgtcgctgaactgaatttgc

SEQ ID NO: 349 - DNA, 20 bp, Artificial Sequence
  Synthetic Construct
gcagacaaacagagcaacga

SEQ ID NO: 350 - DNA, 20 bp, Artificial Sequence
  Synthetic Construct
ccatgagcttgaacaggtaa

SEQ ID NO: 351 - DNA, 20 bp, Artificial Sequence
  Synthetic Construct
tagagggtgtcgatggaagc

SEQ ID NO: 352 - DNA, 19 bp, Artificial Sequence
  Synthetic Construct
catcctcaaggcctcagac

SEQ ID NO: 353 - DNA, 22 bp, Artificial Sequence
  Synthetic Construct
ctcagaaaggttgtagttgtga

SEQ ID NO: 354 - DNA, 20 bp, Artificial Sequence
  Synthetic Construct
ccatgagcttgaacaggtaa

SEQ ID NO: 355 - DNA, 22 bp, Artificial Sequence
  Synthetic Construct
gatgttgtgttttcagtctgca

SEQ ID NO: 356 - DNA, 19 bp, Artificial Sequence
  Synthetic Construct
catcctcaaggcctcagac

SEQ ID NO: 357 - DNA, 19 bp, Artificial Sequence
  Synthetic Construct
atgttcatcgctggcgtcg

SEQ ID NO: 358 - DNA, 21 bp, Artificial Sequence
  Synthetic Construct
ctaaacgtaagagcaggtcaa

SEQ ID NO: 359 - DNA, 22 bp, Artificial Sequence
  Synthetic Construct
ctcagaaaggttgtagttgtga

SEQ ID NO: 360 - DNA, 20 bp, Artificial Sequence
  Synthetic Construct
ccatgagcttgaacaggtaa

SEQ ID NO: 361 - DNA, 22 bp, Artificial Sequence
  Synthetic Construct
gatgttgtgttttcagtctgca

SEQ ID NO: 362 - DNA, 19 bp, Artificial Sequence
  Synthetic Construct
catcctcaaggcctcagac

SEQ ID NO: 363 - DNA, 19 bp, Artificial Sequence
  Synthetic Construct
gcttggcatcacggaagct

SEQ ID NO: 364 - DNA, 20 bp, Artificial Sequence
  Synthetic Construct
ccatgagcttgaacaggtaa

SEQ ID NO: 365 - DNA, 21 bp, Artificial Sequence
  Synthetic Construct
ttgacaagaaaggtccggttg

SEQ ID NO: 366 - DNA, 19 bp, Artificial Sequence
  Synthetic Construct
catcctcaaggcctcagac

SEQ ID NO: 367 - DNA, 20 bp, Artificial Sequence
  Synthetic Construct
atggatgctatccgagccag

SEQ ID NO: 368 - DNA, 22 bp, Artificial Sequence
  Synthetic Construct
ctattcatactcaacagtcaca

SEQ ID NO: 369 - DNA, 57 bp, Artificial Sequence
  Synthetic Construct
gtaacgccagggttttcccagtcacgacggtttaaactcaggtcaaccaccgaggac

SEQ ID NO: 370 - DNA, 68 bp, Artificial Sequence
  Synthetic Construct
cccgtcaccgagatctgatccgtcaccgggatccacttaagcggccgctgaatgggatggttcgattg

SEQ ID NO: 371 - DNA, 68 bp, Artificial Sequence
  Synthetic Construct
gccaagcccaaaaagtgctccttcaatatcatcttctgtcgcggccgcaggtagacgctttgcgagtg

SEQ ID NO: 372 - DNA, 55 bp, Artificial Sequence
  Synthetic Construct
gcggataacaatttcacacaggaaacagcgtttaaactgaactgacgcggactga

SEQ ID NO: 373 - DNA, 68 bp, Artificial Sequence
  Synthetic Construct
aagttcccttcctctggcagcaatcgaaccatcccattcagcggccgcctagcatcgactactgctgc

SEQ ID NO: 374 - DNA, 20 bp, Artificial Sequence
  Synthetic Construct
catgcaaagatacacatcaa

SEQ ID NO: 375 - DNA, 68 bp, Artificial Sequence
  Synthetic Construct
tgattgtaccccagctgcgattgatgtgtatctttgcatggcggccgctcaatgttgactgccccagg

SEQ ID NO: 376 - DNA, 68 bp, Artificial Sequence
  Synthetic Construct
gcacttcttagatacacacacactcgcaaagcgtctacctggcgcgcctgaatgggatggttcgattg

SEQ ID NO: 377 - DNA, 21 bp, Artificial Sequence
  Synthetic Construct
ggcaggtcgcagagcaagaca

SEQ ID NO: 378 - DNA, 21 bp, Artificial Sequence
  Synthetic Construct
ttgacaagaaaggtccggttg

SEQ ID NO: 379 - DNA, 20 bp, Artificial Sequence
  Synthetic Construct
gattcatcacaggggcagtc

SEQ ID NO: 380 - DNA, 20 bp, Artificial Sequence
  Synthetic Construct
tgcgtcgccgtctcgctcct

SEQ ID NO: 381 - DNA, 19 bp, Artificial Sequence
  Synthetic Construct
acgccgttgctgagccttg

SEQ ID NO: 382 - DNA, 20 bp, Artificial Sequence
  Synthetic Construct
ttaggcgacctctttttcca

SEQ ID NO: 383 - DNA, 20 bp, Artificial Sequence
  Synthetic Construct
gagcccatcatcaacacctc

SEQ ID NO: 384 - DNA, 19 bp, Artificial Sequence
  Synthetic Construct
tgccaaggtcgtagacgga

SEQ ID NO: 385 - DNA, 58 bp, Artificial Sequence
  Synthetic Construct
ggtaacgccagggttttcccagtcacgacggtttaaacgtcgagccccctggacacct

SEQ ID NO: 386 - DNA, 68 bp, Artificial Sequence
  Synthetic Construct
gcgctggcaacgagagcagagcagcagtagtcgatgctaggcggccgccatcgccgtcgcggacatga

SEQ ID NO: 387 - DNA, 68 bp, Artificial Sequence
  Synthetic Construct
tgattgtaccccagctgcgattgatgtgtatctttgcatggcggccgctcgacgttgtatctgcactc

SEQ ID NO: 388 - DNA, 68 bp, Artificial Sequence
  Synthetic Construct
gtacgttctgattgccaactacggaccagaccagggctccggcgcgcccatcgccgtcgcggacatga

SEQ ID NO: 389 - DNA, 20 bp, Artificial Sequence
  Synthetic Construct
ggagccctggtctggtccgt

SEQ ID NO: 390 - DNA, 58 bp, Artificial Sequence
  Synthetic Construct
agcggataacaatttcacacaggaaacagcgtttaaacacgcgcttcaacatgcccca

SEQ ID NO: 391 - DNA, 60 bp, Artificial Sequence
  Synthetic Construct
gctggccgctgggaatagcgtcatgtccgcgacggcgatggaattcggtctgaaggacgt

SEQ ID NO: 392 - DNA, 22 bp, Artificial Sequence
  Synthetic Construct
gttgagagaagttgttggattg

SEQ ID NO: 393 - DNA, 62 bp, Artificial Sequence
  Synthetic Construct
aaccaaagactttttgatcaatccaacaacttctctcaacatgaagatttcctcgatccttg

SEQ ID NO: 394 - DNA, 19 bp, Artificial Sequence
  Synthetic Construct
tcagcgccgtaacctctgc

SEQ ID NO: 395 - DNA, 61 bp, Artificial Sequence
  Synthetic Construct
tgatggtgatgaggcggaaaagcagaggttacggcgctgaggatccacttaacgttactga

SEQ ID NO: 396 - DNA, 71 bp, Artificial Sequence
  Synthetic Construct
tctctcaaaggaagaatcccttcagggttgcgtttccagtgcggccgctctccttctagaaagaaggatta

SEQ ID NO: 397 - DNA, 20 bp, Artificial Sequence
  Synthetic Construct
actggaaacgcaaccctgaa

SEQ ID NO: 398 - DNA, 58 bp, Artificial Sequence
  Synthetic Construct
tctgattgccaactacggaccagaccagggctccggcgcggcggccgctagatctacg

SEQ ID NO: 399 - DNA, 66 bp, Artificial Sequence
  Synthetic Construct
gtacacttgtttagaggtaatccttctttctagaaggagagcggccgcggagccctggtctggtcc

SEQ ID NO: 400 - DNA, 59 bp, Artificial Sequence
  Synthetic Construct
gcgctggcaacgagagcagagcagcagtagtcgatgctagaagctgacgggcgtcaacg

SEQ ID NO: 401 - DNA, 19 bp, Artificial Sequence
  Synthetic Construct
tagcatcgactactgctgc

SEQ ID NO: 402 - DNA, 70 bp, Artificial Sequence
  Synthetic Construct
gtacgttctgattgccaactacggaccagaccagggctccgcggccgccatgcaaagatacacatcaatc

SEQ ID NO: 403 - DNA, 20 bp, Artificial Sequence
  Synthetic Construct
gattcatcacaggggcagtc

SEQ ID NO: 404 - DNA, 20 bp, Artificial Sequence
  Synthetic Construct
ccgctctcaaactgcccaaa

SEQ ID NO: 405 - DNA, 19 bp, Artificial Sequence
  Synthetic Construct
acgtgaagttgcccatcaa

SEQ ID NO: 406 - DNA, 20 bp, Artificial Sequence
  Synthetic Construct
ccatgagcttgaacaggtaa

SEQ ID NO: 407 - DNA, 20 bp, Artificial Sequence
  Synthetic Construct
gaccaatggcttcacgaagt

SEQ ID NO: 408 - DNA, 20 bp, Artificial Sequence
  Synthetic Construct
ttaggcgacctctttttcca

SEQ ID NO: 409 - DNA, 19 bp, Artificial Sequence
  Synthetic Construct
acgtgaagttgcccatcaa

SEQ ID NO: 410 - DNA, 24 bp, Artificial Sequence
  Synthetic Construct
taacttgtacgctctcagttcgag

SEQ ID NO: 411 - DNA, 20 bp, Artificial Sequence
  Synthetic Construct
gaccaatggcttcacgaagt

SEQ ID NO: 412 - DNA, 20 bp, Artificial Sequence
  Synthetic Construct
ttaggcgacctctttttcca

SEQ ID NO: 413 - DNA, 20 bp, Artificial Sequence
  Synthetic Construct
cagcagcaccgcatccacca

SEQ ID NO: 414 - DNA, 20 bp, Artificial Sequence
  Synthetic Construct
gccgaatcgctggttgccct

SEQ ID NO: 415 - DNA, 19 bp, Artificial Sequence
  Synthetic Construct
atggaagccatcctccagg

SEQ ID NO: 416 - DNA, 18 bp, Artificial Sequence
  Synthetic Construct
tggatcatgttggcgacg

SEQ ID NO: 417 - DNA, 17 bp, Artificial Sequence
  Synthetic Construct
gtaagacgccccgtctc

SEQ ID NO: 418 - DNA, 58 bp, Artificial Sequence
  Synthetic Construct
ggtaacgccagggttttcccagtcacgacggtttaaacggaggctgcgacaccgtctg

SEQ ID NO: 419 - DNA, 68 bp, Artificial Sequence
  Synthetic Construct
gcgctggcaacgagagcagagcagcagtagtcgatgctaggcggccgcccggcctgaaacgacctccc

SEQ ID NO: 420 - DNA, 68 bp, Artificial Sequence
  Synthetic Construct
cccgtcaccgagatctgatccgtcaccgggatccacttaagcggccgcgagagagaaacaaaacagtg

SEQ ID NO: 421 - DNA, 68 bp, Artificial Sequence
  Synthetic Construct
acattccgaccgtttactgatccaagccgtgcaaccgactggcgcgccccggcctgaaacgacctccc

SEQ ID NO: 422 - DNA, 20 bp, Artificial Sequence
  Synthetic Construct
agtcggttgcacggcttgga

SEQ ID NO: 423 - DNA, 58 bp, Artificial Sequence
  Synthetic Construct
agcggataacaatttcacacaggaaacagcgtttaaacgagacggacgcctgcaccac

SEQ ID NO: 424 - DNA, 68 bp, Artificial Sequence
  Synthetic Construct
tgattgtaccccagctgcgattgatgtgtatctttgcatggcgatcgcgacagaagatgatattgaag

SEQ ID NO: 425 - DNA, 20 bp, Artificial Sequence
  Synthetic Construct
ttaagtggatcccggtgacg

SEQ ID NO: 426 - DNA, 21 bp, Artificial Sequence
  Synthetic Construct
cctatgagtcgtttacccaga

SEQ ID NO: 427 - DNA, 18 bp, Artificial Sequence
  Synthetic Construct
tggccgagtctatgcgta

SEQ ID NO: 428 - DNA, 20 bp, Artificial Sequence
  Synthetic Construct
ggagttgctttaatgtcggg

SEQ ID NO: 429 - DNA, 20 bp, Artificial Sequence
  Synthetic Construct
ttaggcgacctctttttcca

SEQ ID NO: 430 - DNA, 17 bp, Artificial Sequence
  Synthetic Construct
gtaagacgccccgtctc

SEQ ID NO: 431 - DNA, 18 bp, Artificial Sequence
  Synthetic Construct
tggatcatgttggcgacg

SEQ ID NO: 432 - DNA, 20 bp, Artificial Sequence
  Synthetic Construct
gtcgaagatgtcctcgagat

SEQ ID NO: 433 - DNA, 20 bp, Artificial Sequence
  Synthetic Construct
ggagttgctttaatgtcggg

SEQ ID NO: 434 - DNA, 20 bp, Artificial Sequence
  Synthetic Construct
ttaggcgacctctttttcca

SEQ ID NO: 435 - DNA, 18 bp, Artificial Sequence
  Synthetic Construct
tagtccatgccgaactgc

SEQ ID NO: 436 - DNA, 20 bp, Artificial Sequence
  Synthetic Construct
ccggacctgcaccgcaagtt

SEQ ID NO: 437 - DNA, 20 bp, Artificial Sequence
  Synthetic Construct
agggcaatgtcgcccagcac

SEQ ID NO: 438 - DNA, 17 bp, Artificial Sequence
  Synthetic Construct
gacctgcaccgcaagtt

SEQ ID NO: 439 - DNA, 20 bp, Artificial Sequence
  Synthetic Construct
gtcgagcgtctgatattcac

SEQ ID NO: 440 - DNA, 17 bp, Artificial Sequence
  Synthetic Construct
gacggagacctcccaca

SEQ ID NO: 441 - DNA, 57 bp, Artificial Sequence
  Synthetic Construct
gtaacgccagggttttcccagtcacgacggtttaaaccataaacttgcgcagtcgaa

SEQ ID NO: 442 - DNA, 68 bp, Artificial Sequence
  Synthetic Construct
gcgctggcaacgagagcagagcagcagtagtcgatgctaggcggccgccttctaggatggagcgcttg

SEQ ID NO: 443 - DNA, 68 bp, Artificial Sequence
  Synthetic Construct
caaccagccgcagcctcagcctctctcagcctcatcagccgcggccgcagacggcttcttccaaaaca

SEQ ID NO: 444 - DNA, 57 bp, Artificial Sequence
  Synthetic Construct
gcggataacaatttcacacaggaaacagcgtttaaacccccagggaggctattctac

SEQ ID NO: 445 - DNA, 20 bp, Artificial Sequence
  Synthetic Construct
ctttccaagcgtttgagtcc

SEQ ID NO: 446 - DNA, 20 bp, Artificial Sequence
  Synthetic Construct
ccatgagcttgaacaggtaa

SEQ ID NO: 447 - DNA, 20 bp, Artificial Sequence
  Synthetic Construct
gcgtgttttatcctggtgct

SEQ ID NO: 448 - DNA, 19 bp, Artificial Sequence
  Synthetic Construct
catcctcaaggcctcagac

SEQ ID NO: 449 - DNA, 20 bp, Artificial Sequence
  Synthetic Construct
cacctccgtcgatgagtttt

SEQ ID NO: 450 - DNA, 20 bp, Artificial Sequence
  Synthetic Construct
agaagaaggtggtggtggtg

SEQ ID NO: 451 - DNA, 57 bp, Artificial Sequence
  Synthetic Construct
gtaacgccagggttttcccagtcacgacggtttaaacgtttgagcattctcccaagc

SEQ ID NO: 452 - DNA, 68 bp, Artificial Sequence
  Synthetic Construct
gcgctggcaacgagagcagagcagcagtagtcgatgctaggcggccgccgccattttgaagaagatgc

SEQ ID NO: 453 - DNA, 68 bp, Artificial Sequence
  Synthetic Construct
caaccagccgcagcctcagcctctctcagcctcatcagccgcggccgcatgctccctcgtcattaagc

SEQ ID NO: 454 - DNA, 57 bp, Artificial Sequence
  Synthetic Construct
gcggataacaatttcacacaggaaacagcgtttaaacacaacaccttctccgacacc

SEQ ID NO: 455 - DNA, 20 bp, Artificial Sequence
  Synthetic Construct
atgcccaagtttcgtacctg

SEQ ID NO: 456 - DNA, 20 bp, Artificial Sequence
  Synthetic Construct
ccatgagcttgaacaggtaa

SEQ ID NO: 457 - DNA, 20 bp, Artificial Sequence
  Synthetic Construct
ggcgcattcagaagaagaac

SEQ ID NO: 458 - DNA, 19 bp, Artificial Sequence
  Synthetic Construct
catcctcaaggcctcagac

SEQ ID NO: 459 - DNA, 20 bp, Artificial Sequence
  Synthetic Construct
cacttgatgaacgctggcta

SEQ ID NO: 460 - DNA, 20 bp, Artificial Sequence
  Synthetic Construct
cgtaatggcgttgttgacag

SEQ ID NO: 461 - DNA, 57 bp, Artificial Sequence
  Synthetic Construct
gtaacgccagggttttcccagtcacgacggtttaaacgaggcagccaaaaagtgaag

SEQ ID NO: 462 - DNA, 68 bp, Artificial Sequence
  Synthetic Construct
gcgctggcaacgagagcagagcagcagtagtcgatgctaggcggccgctgaaagaaggcaggaccagt

SEQ ID NO: 463 - DNA, 68 bp, Artificial Sequence
  Synthetic Construct
caaccagccgcagcctcagcctctctcagcctcatcagccgcggccgcaagaggctcggacaaagaca

SEQ ID NO: 464 - DNA, 57 bp, Artificial Sequence
  Synthetic Construct
gcggataacaatttcacacaggaaacagcgtttaaacgatcgtggtgcacgagacta

SEQ ID NO: 465 - DNA, 20 bp, Artificial Sequence
  Synthetic Construct
gcactgcgttgcctttctat

SEQ ID NO: 466 - DNA, 20 bp, Artificial Sequence
  Synthetic Construct
ccatgagcttgaacaggtaa

SEQ ID NO: 467 - DNA, 20 bp, Artificial Sequence
  Synthetic Construct
gaaagcatggctcgtttctc

SEQ ID NO: 468 - DNA, 19 bp, Artificial Sequence
  Synthetic Construct
catcctcaaggcctcagac

SEQ ID NO: 469 - DNA, 20 bp, Artificial Sequence
  Synthetic Construct
acccggctcaactagctaca

SEQ ID NO: 470 - DNA, 20 bp, Artificial Sequence
  Synthetic Construct
agctggcctttcgttacaga

SEQ ID NO: 471 - DNA, 57 bp, Artificial Sequence
  Synthetic Construct
gtaacgccagggttttcccagtcacgacggtttaaacttggtttgaacagctgcaag

SEQ ID NO: 472 - DNA, 68 bp, Artificial Sequence
  Synthetic Construct
gcgctggcaacgagagcagagcagcagtagtcgatgctaggcggccgctttgcagcaagatgtcgttc

SEQ ID NO: 473 - DNA, 68 bp, Artificial Sequence
  Synthetic Construct
caaccagccgcagcctcagcctctctcagcctcatcagccgcggccgcgctgtgaagacgggcttatc

SEQ ID NO: 474 - DNA, 57 bp, Artificial Sequence
  Synthetic Construct
gcggataacaatttcacacaggaaacagcgtttaaaccaagaacagcatcgaggaca

SEQ ID NO: 475 - DNA, 19 bp, Artificial Sequence
  Synthetic Construct
gggcgacgacgagttttat

SEQ ID NO: 476 - DNA, 20 bp, Artificial Sequence
  Synthetic Construct
ccatgagcttgaacaggtaa

SEQ ID NO: 477 - DNA, 20 bp, Artificial Sequence
  Synthetic Construct
gaatggatcaagtcgctgct

SEQ ID NO: 478 - DNA, 19 bp, Artificial Sequence
  Synthetic Construct
catcctcaaggcctcagac

SEQ ID NO: 479 - DNA, 20 bp, Artificial Sequence
  Synthetic Construct
ctcaggctctgcttggattc

SEQ ID NO: 480 - DNA, 20 bp, Artificial Sequence
  Synthetic Construct
atgccaaaaagactgctgct

SEQ ID NO: 481 - DNA, 57 bp, Artificial Sequence
  Synthetic Construct
gtaacgccagggttttcccagtcacgacggtttaaacgcctccctggtattcagaca

SEQ ID NO: 482 - DNA, 68 bp, Artificial Sequence
  Synthetic Construct
gcgctggcaacgagagcagagcagcagtagtcgatgctaggcggccgcgacgccagaaagaaatgctc

SEQ ID NO: 483 - DNA, 68 bp, Artificial Sequence
  Synthetic Construct
caaccagccgcagcctcagcctctctcagcctcatcagccgcggccgcgacctggtcagctgctcttt

SEQ ID NO: 484 - DNA, 57 bp, Artificial Sequence
  Synthetic Construct
gcggataacaatttcacacaggaaacagcgtttaaactggaaccacatcgacttcac

SEQ ID NO: 485 - DNA, 20 bp, Artificial Sequence
  Synthetic Construct
aaccaccttgtcaccgtctc

SEQ ID NO: 486 - DNA, 20 bp, Artificial Sequence
  Synthetic Construct
ccatgagcttgaacaggtaa

SEQ ID NO: 487 - DNA, 20 bp, Artificial Sequence
  Synthetic Construct
gtcgtcgaggctgctttatc

SEQ ID NO: 488 - DNA, 19 bp, Artificial Sequence
  Synthetic Construct
catcctcaaggcctcagac

SEQ ID NO: 489 - DNA, 20 bp, Artificial Sequence
  Synthetic Construct
gatctcgaatccgaggacaa

SEQ ID NO: 490 - DNA, 20 bp, Artificial Sequence
  Synthetic Construct
ccggtagcgttagagagacg

SEQ ID NO: 491 - protein, 417 aa, Myceliophthora thermophila
MHLTPALVAATCAVEVCAGVLPRSSSTPTTFGSGTLSLKQVRNPNFVRNGPVQLARIYHKYGVPLPHDLREAVARFRAEIRKRSNGSTETNPETNDVEYLTPVSIGTPPQVLNLDFDTGSSDLWVFSSETRSSDVQGQTIYDPNESSTAQKLQGYSWQISYGDGSSSSGDVYTDAVTVGGLTVPSQAVEVARRVSDEFTSDPNNDGLLGLGFSSINTVQPVPQKTFFDNAKADLDAPIFTADLKASAPGFFNFGYIDHGAYTGEITYMPVDSSDGFWAWTSPGYAVGSGSFKRTTIQGIADTGTSLFLLPSSVVSAYYGQISGAKYDSIQGGYTLPCSGSVPDFAFGIGDSNTTISVPGDYVRYAATDSSGIICFGGIQANTGIGFSIFGDVALKAAFVVFDGAKQQLGWASKPLPS

SEQ ID NO: 492 - protein, 396 aa, Penicillium chrysogenum
MVVFSKVTASLACFSAVVSAAAVPVKSPRQGFSVNQVQKTVTGTRTVNLPGVYANALAKYGATVPANVHAAAVSGSAITTPEENDVEYLTPVKIGESTLNLDFDTGSADLWVFSTELSSAEQSGHDVYDVSSSGKKLTGASWSISYGDGSGASGDVYKDTVTVGGVKATGQAVEAAKKISQQFVQDKSNDGLLGLAFSSINTVSPKPQTTFFDTVKSDLDKPLFAVTLKHGAPGTYDFGYIDKKKFTGSLTYTDVDNSQGFWSFTADSYKVGTGSAGPSIEGIADTGTTLLLLDDGVVSDYYKKVDGAKNNYSAGGYVFPCDADLPDFTVTIGSYDAVVPGKHIKYAPVTTGSSSCFGGIQSNSGIGFSIFGDIFLKSQYVVFDAEGPRLGFAAQA

SEQ ID NO: 493 - protein, 394 aa, Aspergillus niger
MVVFSKTAALVLGLSSAVSAAPAPTRKGFTINQIARPANKTRTINLPGMYARSLAKFGGTVPQSVKEAASKGSAVTTPQNNDEEYLTPVTVGKSTLHLDFDTGSADLWVFSDELPSSEQTGHDLYTPSSSATKLSGYTWDISYGDGSSASGDVYRDTVTVGGVTTNKQAVEAASKISSEFVQDTANDGLLGLAFSSINTVQPKAQTTFFDTVKSQLDSPLFAVQLKHDAPGVYDFGYIDDSKYTGSITYTDADSSQGYWGFSTDGYSIGDGSSSSSGFSAIADTGTTLILLDDEIVSAYYEQVSGAQESEEAGGYVFSCSTNPPDFTVVIGDYKAVVPGKYINYAPISTGSSTCFGGIQSNSGLGLSILGDVFLKSQYVVFNSEGPKLGFAAQA

SEQ ID NO: 494 - protein, 386 aa, Aspergillus nidulans
MVVFSKVAAAAFGLSAVASAMPAAPPRQGFTINQLTRAIPKRTINLPAIYANALSKYGGNVPPHIQDAMAHGSAVTTPEQYDVEYLTPVAVGGTTMNLDFDTGSADLWVFSNELPSSQTTGHSVYKPSDNGTRMSGYSWEISYGDGSSAGGDVYRDTVTVGGVTAPGQAVEAASHISEQFTRDQNNDGLLGLAFSSINTVQPKSQTTFFDSVKSQLESPLFAVTLKHQAPGSYDFGYIDQSKYTGELTYTDVDNSQGFWMFSATAGETDFDAIADTGTTLIMIDQSIAEDYYSQVPLAFNNFFYGGWTFPCSAELPSFTVTINGYDAVVPGEHIKYAPVTDGSSTCFGGIQDNQGLPFSILGDVFLKSQYVVFDSEGPQLGFAPQA

SEQ ID NO: 495 - protein, 434 aa, Neurospora crassa
MLLFPTILTAALAATGMAAAIPSRDDTTANKGTASLLQVRNPSFEFRHGPLALAKAYQKFGAPMPEDLRAAIARFRQNQKRTTGTIATDPEKHDVEYLTPISVGTPSQDLVVDFDTGSSDLWVFSTEMSTSDIKGQTVYDPNNSSTSEKVQGSTWKITYGDGSSSSGDVYLDTVTIGNLTVPSQAVEAAKKVSSEFTDDSHNDGLLGLGFSAINAVEPTPQNTFFDNIKGSLDAPLFTVDLKHGTPGSFNFGYIDPAAYIGNISWTPVDSSQGYWGFTSPGYAVGTGAFRNHSISGIADTGTTLLLLPKSVVSAYYKEIQGAQYDSDQGGYIFPCSPTPPDFVFGVNKGIVTVPGDMVSYAPADSANQNCFGGIQTDTGIGFSIFGDVALKTSFVHLHGSIVPGYYADCAMRFNRMLRSYSNDQLVDFSSSGPL

SEQ ID NO: 496 - protein, 466 aa, Myceliophthora thermophila
MDALFETHAKLRKRMALYRVRAVPNQNYQRDGTKSYVSVLNRFGFQPTKPGPYFQIFEESEEAPSMSAAPGVKPGHVWQGLFKKLKDQEEPGEVTAEDQQNDSEYLCEVMIGTAWTAERQIVKMDFDTGLADFWVSQKSFDPKKSVTWQLAKDKSWKVQYGDGSSASGIVGHDILIIGGIQIKRQAIEIATEMSAQFSEGTMDGILGLAFSKLNTVQTDGKPDPQRTVVDNMMAQDDIPPEAELFSTALYSNREDDQRSFYTFGWIDEDLVKASGEEIVWTDVDNSEGFWMFSSEHVTIDGQQVRIEGNKAIADTGTSLVLVSDQVCDALYAHIPSAEYSEEYQGWTFPQETEVDKLPEFSIAIGDKEFVLQKEDLIFAPADERVFYGSVQSRGENPFDILGIAFLKSIYAIWDQGHKRFGAVPKMEAFVPPTKYDRPRLTDQDRKDLGVTIGYGDISSTFFEKRA

SEQ ID NO: 497 - protein, 419 aa, Penicillium chrysogenum
MTRIKLIANPHYQKSGTKSYLYAMRKYRFTPTKDGPYFLGTTMVQTGRQFTNKPVGGRARLQQVLQKKDAVSDEVGQVGVHDVQNDSMYLAEIGIGTPAQTLNLDFDTGSADLWVWSTELSSKILSANKNHRVFDPTKSSTFEEKDGSTWQIKYGDGSFASGTVGNDNVTIGGLVVKGQAVGIADILSEQFAQGAGDGLLGLAFSNINTVKPEAVAMPVENMISQADIPKSAELFTAKLGSWRDTDEPDKGESFYTFGYVDQDTVKAAESEIYYTPVDNSQGFWMFDSTSATVNGKSIARAGNKAIADTGTTLALVDDETCQAVYDAIPGAKYDNASQGWIFPSNTPADKLPVVSFAVGEKQFVVQKEDLGFAEAKSGYVYGGIQSRGTMTMDILGDTFLKAIYAVSDMLFFGVHSCTN

SEQ ID NO: 498 - protein, 420 aa, Aspergillus oryzae
MASKIFLIENPNYCKSGIKSYVHLIRKYRLHPTKNGPYSIGRAIHQTGRPFTDKPIGGRVRFHDVMRKQTSDDQLQQVEKDDIQNDAAFFMPVSIGTPAQTFNLVLDTASVDFWVRSSELPADTLPKGEEESHTFDPEKSSTFKNIEDSPWKVTYVDGSSVSGSIGTEDITIGGVAFKTQPVQLAKTMSPMFTQFSADGVLGLAFGHINHPQQDIKALAERLNTRDDREQSAKLFTAKFGSWGDSDLKKSFCTFGSIDEDAVRYCGHDVHHTPIDNSRGYWMFESPSATVGGKPMSRSENKAVVDTDAALTLLDDQTCQAIYDSIPGAFYDSETQGFLIPSDINVDQLPVVQLAVGEKSFAMSKESLMFAEAKPGYIYGGVQSRGSLEFDVLGGTFLDGLYAIFDFGSLRFGAVQAKTKV

SEQ ID NO: 499 - protein, 397 aa, Myceliophthora thermophila
MKDAFLLTAAVLLGSAQGAVHKMKLQKIPLSEQLEAVPINTQLEHLGQKYMGLRPRESQADAIFKGMVADVKGNHPIPISNFMNAQYFSEITIGTPPQSFKVVLDTGSSNLWVPSVECGSIACYLHSKYDSSASSTYKKNGTSFEIRYGSGSLSGFVSQDTVSIGDITIQGQDFAEATSEPGLAFAFGRFDGILGLGYDRISVNGIVPPFYKMVEQKLIDEPVFAFYLADTNGQSEVVFGGVDHDKYKGKITTIPLRRKAYWEVDFDAISYGDDTAELENTGIILDTGTSLIALPSQLAEMLNAQIGAKKSYTGQYTIDCNKRDSLKDVTFNLAGYNFTLGPYDYVLEVQGSCISTFMGMDFPAPTGPLAILGDAFLRRYYSIYDLGADTVGLAEAK

SEQ ID NO: 500 - protein, 398 aa, Penicillium chrysogenum
MKSFTLLTASALLGSAAAEVHRLKLNKVPLAEQLNTHNIDAHVHNLGQKYMGIRPEKHQDLFHDTSFNPAAGHDVLVDNFLNAQYFSEISIGTPPQTFKVVLDTGSSNLWVPSSQCSSIACFLHSKYDSSSSSTYEKNGTEFEIRYGSGSLSGFVSRDTLQIGDLKVKGQDFAEATNEPGLAFAFGRFDGILGLGYDTISVNKMVPPFYHMINQKLVDEPVFAFYLGDANKDGDNSVATFGGIDESHYTGELIKIPLRRKAYWEVELNSIALGDNVAELENTGVILDTGTSLIALPSTMAELLNKEIGATKGFTGQYSVECDKRDSLPDLTFTLGGHKFTIGPYDYVLEVQGSCISSFMGMDFPEPVGPLAILGDAFLRRWYSVYDVGNNAVGLAKAK

SEQ ID NO: 501 - protein, 397 aa, Aspergillus oryzae
MKSTLVTASVLLGCASAEVHKLKLNKVPVSEQFNLHNIDTHVQALGQKYMGIRPNIKQDLLNENPINDMGRHDVLVDNFLNAQYFSEIEIGTPPQKFKVVLDTGSSNLWVPSSECGSIACYLHNKYDSSSSSTYQKNGSEFAIKYGSGSLSGFVSQDTLKIGDLKVKDQLFAEATSEPGLAFAFGRFDGILGLGFDTISVNKIPPPFYSMLDQGLLDEPVFAFYLGDTNKEGDDSVATFGGVDKDHYTGELVKIPLRRKAYWEVDLDAIALGDSVAELDNTGVILDTGTSLIALPTTLAELINKEIGAKKGFTGQYSVDCDKRDSLPDLTFTLSGYNFTIGPYDYTLEVQGSCISAFMGMDFPEPVGPLAILGDAFLRKWYSVYDLGNGAVGLAKAK

SEQ ID NO: 502 - protein, 394 aa, Aspergillus nidulans
MKASLLTASVLLGYASAEVHKLKLNKVPLTEQFITRNIADHANALGQKYMGQFQQHVLEDEPVNAMRGHDVLVDNFMNAQYFSEIQLGTPPQTFKVVLDTGSSNLWVPSSECGSIACYLHQKFDSSASSTYKKNGSEFAIKYGSGSLSGFVSRDNLQIGDLKVKGQDFAEATSEPGLAFAFGRFDGILGLGFDTISVNRIVPPFYNMIHQGLLDEPVFAFYLGDANKDGDSSVATFGGIDKDHYEGELIKIPLRRKAYWEVDLDAIALGDEVAELENTGVILDTGTSLIALPSNLAEMINTEIGATKGFTGQYTIDCAKRDSLPDLTFTLTGHNFTIGPYDYTLEVQGSCISAFMGMDFPEPVGPLAILGDAFLRKWYSVYDLGNGAVGLAKAK

SEQ ID NO: 503 - protein, 454 aa, Myceliophthora thermophila
MKFAALALAASLVAAAPRVVKVDPSDIKPRRLGGTKFKLGQIHNDLFRQHGRGPRALAKAYEKYNIELPPNLLEVVQRILKDLGIEPHSKKIPGSKSSYGNGAPYTNETDDSGEVSAIPQLFDVEYLAPVQIGTPPQTLMLNFDTGSSDLWVFSSETPSRQQNGQKIYKIEESSTARRLSNHTWSIQYGDGSRSAGNVYLDTVSVGGVNVFNQAVESATFVSSSFVTDAASSGLLGLGFDSINTVKPTKQKTFISNALESLEMGLFTANLKKAEPGNYNFGFIDETEFVGPLSFIDVDSTDGFWQFDATGYSIQLPEPSGNITGTPFRAVAHTAIADTGTTLLLLPPGIAQAYYWQVQGARQAPEVGGWVMPCNASMPDLTLHIGTYKAVIPGELIPYAPVDTDDMDTATVCYGGIQSASGMPFAIYGDIFFKAQFTVFDVENLKLGFAPKPEL

SEQ ID NO: 504 - protein, 545 aa, Aspergillus nidulans
MSVLLVFSLVTFALQGLCSLSLHESDSPHVLQLGLRRNQHNDPVGRDRRRFKRQTGTVAVDLHGDSMGGDIYSTNLTIGDPPQAVEVSVDTGSADLWVVYSENPVCNVRGARCDDSGTYDPTASTSFDGLSDEFAIEYGDSSWAEGYYGIDTLTVADAEVSEVQFAVAVESSIDKGILGIGYSTNVVSTYRYPNLPERLVASNITSSNAYSLWLNRLGSDEGTILFGGVNTAHYTGPLRTLPVVRYNGHYIHLWLTLTGMGVESASDDITKSYSETRSTTGEQEFPFVALLDSGATLTYLPSNIVAQIFSDLDVHLYEPEQFGYVPCDTYLVGREDYNLTFTFSGVTIRVPLRELVLRDAISGPGRDALQLPNNADEESCLFGILPNTDLFPILGDTFLRSAYVVFDLDNNEISLAQANTAPGDDRILEIGSGDDAVPEAEDVDDPVTTATVSLGGSSLILPTGWTNEPIFPSRTVTTSTTATSTGTNTGSGEDTEATDSDQGTSGGTGTQAEGPVATDGAVGVGNSPLLAIAMAALVLNMVLAL

SEQ ID NO: 505 - protein, 410 aa, Aspergillus niger
MKSTTLLSLAWATQSAYSLSIHERDEPATLQFNFERRQIADRSRRKRSTASADLVNLATNLGYTMNLTLGTPGQEVSVTLDTGSSDLWVNGANSSVCPCTDYGSYNSSASSTYTFVNDEFYIQYVDGSEATGDYVNDTLKFSNVTLTNFQFAVAYDGDSEEGVLGIGYASNEASQATVGGGEYTNFPEALVDQGAINWPAYSLWLDDLDEGKGTILFGGVNTAKYYGSLQTLPIVSIEDMYVEFAVNLTAVHLEKNGNSVSVNNSATQFPIPAVLDSGTALTYIPTSAAASIYEAVGAQYLSEYGYGVIECGVKDEDFTFLFDFGSFNMSVDISEMILEASSDMTDMNVCTFGLAVIENEALLGDTFLRSAYVVYDLGNNEISLAKANFNPGEDHVLEIGTGSDAVPKAT

SEQ ID NO: 506 - protein, 486 aa, Aspergillus oryzae
MMRGASLLPVALAALSCVDALSLHRRDTPATVELPIERRQHAGGLQKRDSTLNLPLINYYDSFYILNLTLGTPAQQFAVALDTGSSDLWVNVANSSYCSSRTNPCKPFGLYDPDASSTYKNLGVEFNATYGDGTNAYGYYATDELGLGDVNVDDMQFGVAESTTITQGIVGVAYDTLTNEASHEGKTYVNLPQALVNSGAIKSPAYSLWLNDPQASRGSILFGGVNKAKYKGELQTIPIVRTLRGYSYLAVTLTGVSVEQGKESEDYSSRLPIVVLLDSGTSLTYLPDSLVDELYKTFNATFLEDDGLAYVDCELMKKDYTVNFDFSGATIAVGISELVLKAVAEDFPLGTCAFGVVPSGDSQDAMYILGDTFLRSAYVVYDLGNNEISLANTNFSPGDDDILEIGTGTSAVPGATPVESPVTSATVASATDIVHTVMVGGTKATATDSNSGAAETSSSSGIAALPTSNTRHLLSGLAGAGLLLAL

SEQ ID NO: 507 - protein, 488 aa, Trichoderma reesei
MRASPLAVAGVALASAAQAQVVQFDIEKRHAPRLSRRDGTIDGTLSNQRVQGGYFINVQVGSPGQNITLQLDTGSSDVWVPSSTAAICTQVSERNPGCQFGSFNPDDSDTFDEVGQGLFDITYVDGSSSKGDYFQDNFQINGVTVKNLTMGLGLSSSIPNGLIGVGYMNDEASVSTTRSTYPNLPIVLQQQKLINSVAFSLWLNDLDASTGSILFGGIDTEKYHGDLTSIDIISPNGGKTFTEFAVNLYSVQATSPSGTDTLSTSEDTLIAVLDSGTTLTYLPQDMAEEAWNEVGAEYSNELGLAVVPCSVGNTNGFFSFTFAGTDGPTINVTLSELVLDLFSGGPAPRFSSGPNKGQSICEFGIQNGTGSPFLLGDTFLRSAFVVYDLVNNQIAIAPTNFNSTRTNVVAFASSGAPIPSATAAPNQSRTGHSSSTHSGLSAASGFHDGDDENAGSLTSVFSGPGMAVVGMTICYTLLGSAIFGIGWL

SEQ ID NO: 508 - protein, 488 aa, Trichoderma virens
MKASPLAVAGVVLASAAQAQVVQFDIEKRHAPSLRRRDATIDATLSNEKVQGGYFINVQVGTPGQNITLQLDTGSSDVWVPASTAAICTEVSQQNPGCTFGSFNPDDSSTFQVVGQNLFDITYVDGSSSKGDYIQDNFQINGLTVKNLTMGLGLDTSISNGLVGVGYINDEASLGTTRSTYPNLPVVLQQEKLINTVAFSLWLNDLDASTGSILFGGIDTEKYQGELTRINIISPDGGKTFTEFAVNLYSVQASSQSGTDTLSTSENTLVAVLDSGTTLTYLPQDMAEEAWNEVGATFSSELGLAVVPCSVGNKNGHFSFKFAGADGPTVNVTLSELVLDLFSGGPPPQFSSGPNKGQSICEFGIQNTTDAPYLLGDTFLRSAFVTYDLVNNQIGIAPTNFNSTQTNIVAFASSGAPIPSSTAAPNQSNTGHSSSTQSGLSAASGFQDGGNDNAAPLTSAFSGPGMFVVGMTICYTLLGSAVFSFRWL

SEQ ID NO: 509 - protein, 488 aa, Trichoderma atraviride
MKASPLAAAGVALASTAQAQVVQFDIQKRDGPNLRDLGRRAATINGVLSNQQIQGGYFLNVEVGTPPQNITLQLDTGSSDVWVPSSSADICTQVSQRNPGCTFGSFDSDKSTSLRTVGKDEFDITYVDNSFSKGDYIQDDFHIGGVTVSNLTMGLGLDSSIANGLIGVGYINDEASLSTIRSTYPNLPVVLQQEKLINTVAYSLWLNDLDASAGSILFGGIDTEKYQGDLTKINIQRADNSNVFTEFAVELFEVQATSPSGTDTLSTSVDSLVAVLDSGTTLTYLPQDMAEQAWKEVGASFNEEFGLAVVPCSIRNVNGHFSFTFAGADGPKINVTMAELALDLFSGGPQPKFSSGPNQGQSVCEFGIQNTTGSPFLLGDTFLRSAFVVYDLVNNEIAIAPTNFNSTKTNVVAFASSGAPIPSATSAPNQSKSGPSSGTGGMSAASGFQDSDNAAPYTSAFSGPGAIIVGMTIGYTLLGGAIFGAGWL

SEQ ID NO: 510 - protein, 504 aa, Neurospora tetrasperma
MKGYTSSALLLGPALLSQLALAQQAPSGVVHWGIQKRHAPNAPNRLLRRAGPTHQAILQNEQARGGYFATCEMGTPGQKVTLQLDTGSSDVWVPDSTASICNKGACDLGSFDPSKSETYTVVGQGEFDISYVDGSSSKGDYFTDVFNIGGTTVTNLTMGLGAQTDIAYGLVGIGYAINEAIVGNSHSLSSQYPNLPVAMVDDGLINTIAYSLWLNDLDADEGSILFGGIDTKKYKGDLTRIRIYPSSNGYYFSFIVALTSLQAISPSGNDTLTSQEFPIPVVLDSGTTLSYLPQDIVDQIWQEVGAEYSDRLELAVIPCSKKSSNGYFSFGFAGPDGPRITVRMDELVLDLTSGDPPKYTSGPNKGQDVCEFGIQNSTSAPYLLGDTFLRSAYVVYDLVNNEIALAETDFNSTESNIVAFASMSATIPSATQAPNQAAVTNRPVATMPSFAASSGFSDTGGSGNDGKDENASAGMPSAFGVAQMSVMGIAMVFAMIGSGVFVLL

SEQ ID NO: 511 - protein, 501 aa, Myceliophthora thermophila
MRGYAAVAFGAILAGAVHASAGNGVVQWDIRRTQRQEELQRLNRRLRKRANPVLEVITNEKIRGGYFATCKIGTPGQDLTLQLDTGSSDIWVPDSAAQVCREIGTEGCALGTFNPNRSSSFEVIGEGQFDIEYVDGSSSKGDYFTDVFQIGDISVQNMTMGLGLHTDIAYGLVGVGYAINEAIVATTQSRDSVYPNLPVQMVDQGLINTVAYSLWLNDLDASSGSILFGGIDTEKYQGELTRIDIYPTSQGDFSSFVVALTSLEARSPSGQDTLTSQEFPIPVVLDSGTTLSYLPTDLATQAWKEVGAFYLPEVGAAVLPCDMENSKGSFSFGFAGPDGPRITVGMDELVLDMTDGQAPQFLSGPYKGRDVCQFGIQNFTSAPFLLGDTFLRSAYVVYDLVNNQIGIAATDFNSTDSNIVPFPSMGAPIPSATVAANQREVTRVPTVTEPAYSASQGFMESASGEESLAPGMPAAWGMGQLLVVGVTMALTALGSGLFFVL

SEQ ID NO: 512 - protein, 492 aa, Neurospora crassa
MKGYTSSALLLGPALLSQLALAQQAPNGVVHWGIQKRHAPNAPNRLLRRAGPTHQAILQNEQARGGYFATCAMGTPGQKVTLQLDTGSSDVWVPDSTASICNKGACDLGSWQGEFDISYVDGSSSKGDYFTDVFNIGGTTVTNLTMGLGAQTDIAYGLVGIGYAINEAIVGNSHSLSSQYPNLPVAMVDDGLINTIAYSLWLNDLDAGEGSILFGGIDTKKYKGDLTRIRIYPSSNGYYFSFIVALTSLQAISPSGNDTLTSQEFPIPVVLDSGTTLSYLPQDIVDQIWQEVGAEYSDRLELAVIPCSKKSSNGYFSFGFAGPDGPRITVRMDELVLDLTSGDPPKYTSGPNKGQDVCEFGIQNSTSAPYLLGDTFLRSAYVVYDLVNNEIGLAETDFNSTESNIVAFASMSATIPSATQAPNQAAVTNRPVATMPSFAASSGFSDTGGSGNDGKDENASAGMPSAFGVAQMSVMGIAMVFAMVGSGVFVLL

SEQ ID NO: 513 - protein, 484 aa, Metarhizium anisopliae
MKYSSAVDACVSSVIILAPAVFGQVVRWDIQKHYQASGLRRRAGTLQSDASNNKAQGGYFVAVQIGTPGQELSLQLDTGSSDVWVPSSQAPVCLDKAQGGCPLGSFDFDQSGTFDVIVANGFDISYQDNSSASGDYFADKLEIGSKSLNNFTMGLGKKTDVPFGLIGVGYAGNEASTETANAIYPNLPIAMQEAGIINSVAYSLWLNDLGASTGNILFGGIDTEKYVGHLTKLPIQPENQQFTHFIVSLFSLEATSPSGNDVLTSRELPLKVVLDSGTTLSYLPPDMAAQVWSEVGATYDDMSFQTAIIPCSYASHAGHFSFVFSGPDGPRINVTMDELVLPLTDGEPPTFSSGPHSGQTICEFGIQKSSDTPWLLGDTFLRSAYVVYDLMNNEVGIAPTDFNSTKSNVIAFASKGAAIPSATSVNNGSKSGIQSQPTQTGLSAAKGFQEGSLACSLESLSVFSLTFISMTITALLMGSPIFTD

SEQ ID NO: 514 - protein, 507 aa, Thielavia terrestris
MKGHSAAALGALLVGVVHPVAANGVVQWDIRRSQRSQEFTKLRRRGSTFNEVISNDEARGGYFATCQIGTPGQNLTLQLDTGSSDIWVPDSKASVCRKFGNSGGCNLGAFDSAQSSSFEVVGKGEFDISYVDGSSSKGDYFTDVFSIGGATLQNMTMGLGLETDISYGLVGVGYAVNEAIVGSSQSVSSAYPNLPVNMVNEGLINTVAYSLWLNDLDASSGSILFGGIDTKKYKGDLTRIQIYPATQDIFTSFKVALTSLEAISPSGQDTLTSTAFPIAVVLDSGTTLSYLPTDLAMQIWKEAGAEYSAHYGTAIIPCSMQNSQGYFSFGFAGPGGPRINVTMDELVLDVSTDGGPQFTSGQYKGETICEFGIQNISSSPYLLGDTFLRSAYVVYDLVNNEVGIAQTDFNSTESNVVAFASMSATIPSATVAPSQAEVTNRPTVTVPAYAASKGFTDLSASGTAASTSAEQNAATPTPSRASTGQMLVVSLTMLLTAVGSGLFVAIL

SEQ ID NO: 515 - protein, 494 aa, Fusarium oxysporum
MKSSLVGASLVSTLGLVQAQTIQWNIEGRHPQPHLARRAKTTYEEVISNDRSEGGYFTEVTIGNPPQNITLQLDTGSSDVWVPWNCADICEDDKNGKSGCPLGSFDPDKSKTFKHVAPGMFGITFVDDSYVKGDYFEDHFELDGAVINNLTMGLAIKTNISYGLIGVGYAKNEASGSTTDVIYPNLPVAMYQAGYINTIAYSVWLNDLDAKAGSILFGGVDTAKYVGDMHRIDIQKLDGHYYHFVVALTSLVATSSSGSDVLTSDSFPIQAVLDSGTTLSYLPQDLAHEIWEEVGAVWSPYYGVAVLPCAYGRNQGNFTFGFAGPDGPSISVGMDELVLSMTSDAANMPVFESGAYKGENICTFGIQNDTNDLYLLGNTFLRSAYVVYDLVNNEVGIAATDFNSTKSKRVPFKSYGATIPSATASSNQHRATEKPTVPGHNFTAAEGFQESDSNGNGDKDNAGSLLNPPTTPLALVVTTMSFMLAGGGIFSSIF

SEQ ID NO: 516 - protein, 492 aa, Gibberella zeae
MKSWLWGASLVSTWGLVYAQTVQWSIEGRHPQPQLARRTKTTYEEVISNDRSEGGYFTEVTIGSPPQKVTLQLDTGSSDVWVPWNCADVCTDNDNGKGGCPLGSFDPDKSKSFKHVAPGMFGITFVDNSYVKGDYFEDHFELDGAVINNLTMGLAVKTNISYGLIGVGYAKNEASGSTTDVIYPNLPVAMYEAGYVNTIAYSVWLNDLDAKAGTVLFGGVDTAKYVGDMHRIDIQKVDGHYYHFVVALTSLVATSSSGSDNLTSECFPIPAVLDSGTTLSYLPHDLATEIWQEVGAVWSPYYGVAVLPCAYGRNNGNFTFGFAGPDGPVISVGMDELVLTMASDRANMPVFQSGPYKGHTMCSFGIQNDTSDLYLLGNTFLRSAYVVYDLVNNEVGIAATDFNSTATKRVAFKSYGASIPSATAVANQHKATENPSVSGHNFTAADGFQESDWDSDDEDNAAISLTPSGTPLVMAVVTMGFVLLGGGIFHTF

SEQ ID NO: 517 - protein, 484 aa, Magnaporthe oryzae
MLGISALLIVCASLGSFAAASDGVVQWHIERRQVPTPTAKLAKRVATTFEEVIQNEKSRGGYFAKCSVGGQDVTLQLDTGSSDLWVPAESACQSDRVPNGCSLGSFKKDLSSSFKVTGKDQFSIQYIDGSFARGDYFTDAFSIGGVRVINLTMGLGKQTDIPYGLAGVGYALNEAIVGGNSSNFTTYPNLPATMLNDGLINTNAFSLWLNNLDASTGRILFGGVDVAKFKGGMARIRIYEDVFSQEYMSFTVALTSLEAHSGSGQDTLTSRSFPIPVVLDSGTTLSYLPNDLAVQTWTEVGALYSAEYGQALLPCAMEDSKGYFVFGFAGPDGPKIQVEMKELVLDLTNGPAPKFTNGKYQGQDACTFGIQNFTGQTMVLGDTFLRSAYVVYDLVNHEIGIAQTDFNSTTSEIIAFPSSGAPIPSATLAPNQDQAVVKPQVTIPAFNAQPGFREGVSQATPLLKPLNKTHILLMCAAIALIMSG

SEQ ID NO: 518 - protein, 474 aa, Penicillium chrysogenum
MKHAWILLVGLVPAWGLTLHRRDNPAVVQMDIQRKDVLDPITRDRRRKRSTVRQPLDNEETLYFCNVTLGTPEQKVRLVLDTGSSDLWCNTPNSTLCESSENACASGTYDSSSSSSYSFVSSDFNISYADGSGAAGDYVTDTLTIGGTTIKDFQFGIGFSSGSPEGVLGIGYTANEVQVGRNGESAYANLPQAMVNKGVIKSNAYSLWLNDLDANTGSILFGGVNTKKYHGALQTVPIQKVGGRYSEFIIALTEVSLTTSSGQNTYSSSSIPAGVLLDSGSSLTYLPDALVQEIYDDLGVSYESDSGIGYVECSMAEQSILSYTFSSPTINVGIDEMIIDVGDLYFRNGKRACIFGIVPAGTSTAVLGDTFLRSAYVVYDLENNEISLASTNFNSTENDILEIGTGTDSVPGATAVSNPVTTAPVGGTAARIGGPHGGSDLSGSATVNMAIPKATAMPRHMAVGLAGVGALLAL

SEQ ID NO: 519 - protein, 487 aa, Aspergillus oryzae
MQKSWLVLLVACLGLQGTTALTLHRRDLPAVVSLDIKRNNAVDPVARDRMRRKRDKTVEQNLDNEETLYFCNITLGTPKQSLRLVLDTGSSDLWCNAANSTLCSSRDQPCNASGSYDPSSSSSYAYTSSDFNISYADGTGAAGDYVTDTIHIGGATVKDFQFGVGYSSSSAEGVLGIGYTTNEVQVGRLGKSAYANLPQAMVKNGLIQSNAYSLWLNDLGADTGSILFGGVNTEKYHGELQTLPIQTVNGVYSEFIIALTGVSLSSASSHHNYSSSDALPAAVLLDSGSSLTYLPNSIVQDIYDDLGVTYESSSGVGYVPCSLAQQNINVTYTFSSPIITVGIDELVLDAGDLRFRNGARACIFGIVPAGDSTAVLGDTFLRSAYVVYDLSNNEISLANTKFNSTKDNILEIGTGDDSVPGATQVSNPVTSVVADGSGARIGGPTGEIFTDIPSATSSGGAAAPAGPTDVPKHLVLGAAAIGYVLAF

SEQ ID NO: 520 - protein, 454 aa, Aspergillus nidulans
MLRVGFDASTNEIPDPVARDRRRRKRDQTVAQLIDNEETLYFCNLTVGTPGQSLRLILDTGSSDLWCNAANSTLCSSPKDPCRISGSFDPSSSSSYSYISSDFNITYADGTGAAGDYATDTVSIGGATIKDFQFGIGYTSSSAEGVLGIGYPSNEVQVARYGDDAYPNLPRFLMQNGFVQSSAYSLWLNDLEANTGSILFGGVDTEKYRGDLQTLPIQTVNGEYSELIIALTGVSLDTEARKHTVSSNALPAAVLLDSGSSLSYLPDSIAEKIYDDLRISYEPSTGAGYAPCSLARQNINVTFTFSSPEIAVGIDELIIDAGDLRFSNGERACIFGLVPAGDNTAVLGDTFLRSAYVVYDLTNNEISIAKTNFNSTKSNILEIGTGSDAVPGATKVSHPVTSVVADGSGSRIGAPTNTEDIVPSASTGAAVVLGRSTISPVLVGAAALGYMFAF

SEQ ID NO: 521 - protein, 486 aa, Aspergillus niger
MWRVLSLLVAVSFVPLETAKALVLQRREVPAVVTLDIKRNDVSDPVMRDRARRRRDTTTVAQALDNEETLYFCNITLGTPEQSLRLVLDTGSSDLWCNAANSTLCSSSTDPCSTSGTFNSDKSTTYTYVSSDFNISYADGTGAAGVYATDTLHIGASTLEDFQFGIGYTSSSSEGVLGIGYTSNEVQVGRFGDSAYPNLPRAMVKSGLIKSNAYSLWLNDLDANTGSILFGGVNTKKYHGELQTLPIQKVNGIYSEFIIALTGVAFTSGSSSRNYSSDALPAAVLLDSGSSLTYLPDSIVEDIYNDFDVVYEQSSGVGYVPCSLAQNNTNITYTFSSPTITVGVNELVLDVGDLLFQDGERACVFGIVPAGDSTAVLGDTFLRSAYVVYDLANNEISLANTNFDATGNDVLEIGTGEDSVPGATKVANPVTTVAVDGSGARIGGPTGATFTSIPSATSGGHATARFMGATRLLAFGAAVIGYMLTF

SEQ ID NO: 522 - protein, 761 aa, Trichoderma reesei
MRSTLYGLAALPLAAQALEFIDDTVAQQNGIMRYTLTTTKGATSKHLHRRQDSADLMSQQTGYFYSIQLEIGTPPQAVSVNFDTGSSELWVNPVCSKATDPAFCKTFGQYNHSTTFVDAKAPGGIKYGTGFVDFNYGYDYVQLGSLRINQQVFGVATDSEFASVGILGAGPDLSGWTSPYPFVIDNLVKQGFIKSRAFSLDIRGLDSDRGSVTYGGIDIKKFSGPLAKKPIIPAAQSPDGYTRYWVHMDGMSITKEDGSKFEIFDKPNGQPVLLDSGYTVSTLPGPLMDKILEAFPSARLESTSGDYIVDCDIIDTPGRVNFKFGNVVVDVEYKDFIWQQPDLGICKLGVSQDDNFPVLGDTFLRAAYVVFDWDNQEVHIAANEDCGDELIPIGSGPDAIPASAIGKCSPSVKTDTTTSVAETTATSAAASTSELAATTSEAATTSSEAATTSAAAETTSVPLNTAPATTGLLPTTSHRFSNGTAPYPIPSLSSVAAAAGSSTVPSESSTGAAAAGTTSAATGSGSGSGSGDATTASATYTSTFTTTNVYTVTSCPPSVTNCPVGHVTTEVVVAYTTWCPVENGPHPTAPPKPAAPEITATFTLPNTYTCSQGKNTCSNPKTAPNVIVVTPIVTQTAPVVIPGIAAPTPTPSVAASSPASPSVVPSPTAPVATSPAQSAYYPPPPPPEHAVSTPVANPPAVTPAPAPFPSGGLTTVIAPGSTGVPSQPAQSGLPPVPAGAAGFRAPAAVALLAGAVAAALL

SEQ ID NO: 523 - protein, 546 aa, Trichoderma virens
MRSTLYALAAWPLAAQALDFIDSYTSEQNGIMRYTLTTTKGARSKHLHRRQDSADLQSQQTGYFYSIQLEIGTPPQAVSVNFDTGSSELWVNPVCSKATDPAFCETFGRYSNSTTFVDTQAPGGIKYGTGFVDFTYGYDYVQLGSLRINQQVFGVATDSEFASVGILGAGPDLSGWKSPYPFVIDNLAKQGFIQSRAFSLDIRGIDSDRGSVTYGGIDVKKFSGPLAKRPIIPAASSPDGYTRYWVYMDGMSITKEDGSDLEIFDKPNGQPVLLDSGYTVSTLPGPLFEKILLAFPSARLESSSGDYIVDCDIIDSPGRVNFKFGDVVVDVEYKDFIWQQPDLGICKLGVSQDDQFPVLGDTFLRAAYVVFDWDNQNIHIAANEDCGTELIPIGSGPDAIPASAIGQCSSSVNKTTTSAVQTTTSAAASTSKLATTSAVATTSAAATTSGAASSGHLPTTSHHFGNGTVVYSLPTLSSTSVSEQSTDAAKGTTTAAGAGTTAAPTYTSTFTTTNVYTVTSCPPSVTNCPVGHVTTEIVTSYTTWCP

SEQ ID NO: 524 - protein, 549 aa, Trichoderma atroviride
MRSTLYALAAWPLAAQALEFLDDNKNVEEGGIMRYSLTAAKGARSKHLHRRQDTAELQSQETGYFYSIELEIGTPPQAVSVNFDTGSSELWVNPECSKATDPAFCQSFGRYNASKTFVDTKADGGIKYGTGYVDFVYGYDYVQLGSSRISQQLFGVATDSEFASIGILGAGPNLSGWTSSYPLVIDNLAKQGFINSRAFSLDIRGLDSDRGSVIYGGIDTKKFSGPLVKRPIIPAASSPDGYTRYWIYMDGMTITTEDGSHVEIFNKPNGQPVLLDSGYTVSTLPSSIFTKILAAFPMAHIEASSGDYLVPCDIIDTPGSVNFQFGDATVSVDYKDFIWQQPDLGICKLGVSQDDDFPVLGDTFLRAAYVVFDWDNQNIHVAKNEDCGTHLIPIGKGADAVPSGLKGDCAAAGQTTTSAVQTTSAAASTSARVSTSAAATTTSVAITTTAPATSGLKATTSSHRFANGTVTYSVPHGRTTVISEISSAAATQLDTTTAPASGTTAAPTYTSTFTTTNVYTITSCPPSVTNCPVGHVTTEVVTAYTTWCP

SEQ ID NO: 525 - protein, 811 aa, Fusarium pseudograminearum
MLSTLFLAVAAPALATAFNAPNVPVGTDDSSPDGLIRFPLKVSTGAPVVKGVTKRQNEVALESQQNGFFYSIDVTLGTPGQKVTVNLDTGSAELWVNPVCEKAQQPAFCKQFGHFGESSTFVDLNTTGGVVYGTGYAYWNYGYDNVVVGSAAIRNQVFGVAYDSSFTGVGIMGAGPDLNGWDAPYPLVIDSMVKQGLIKSRALSLDIRTLNSDRGAVIFGGIDTAKYTGRLQKLPIIPAASSPDGLTRYWVNLDGISLVQEDGTVDSAFSGSTPQPVLLDSGYTVSALPGSIFNKIVAAFPTAKSNGGAYVDVDCSVADIKGSVDFKFGDKTIKVPYADFIWHNDERCVLGVFQDDEFPVLGDTFLRAAYVVYDWDNRNVWIANNEDCGTNLVAIGTGPDAVPDLVGQCGSDSETTTSASETASATGTETETETASATESEAVTATTEDVTSAETDTTTGYFPTTRYSNGTVSVTGKGTSTTKKATGGSGESYELPSYTDSSASATITSTVVTSKVYTVTACPPSVTNCPVGHVTTETITSLTTYCPGSDGSAPHPTTVEGEGAPHPTGAAHLTSYVTATNMHTVTSCPGEGACHTSVITEIVHNTQIASPEEPTGIFTIPEAIQCGAGNFGCKEATTKGYRTVTITPVVKAPKPTPVPGYCATCGPLKGHGHHNDDDDKETATGGYTAPGKQTGGYDQPTQAHPGQDYPRPTGDSPKPTGGSDKPTGDSDKPSGDAPKPNPLEELQTYRPTNVFPQIPSSVATVVKPTGTPQAGGPSEPAGTPPVVINGASGWNVPVVAAVVVGAFVAAL

SEQ ID NO: 526 - protein, 824 aa, Metarhizium acridum
MMLSSLFSLAALPLATQALAEFPVDNRMVQEPGLIRFPLDIAAGAPTKNRMPKRQNEIGVNAEKSGFFYSIELQVGTPAQAVRVNFDTGSAELWINPVCSKSTDPGFCDKLGRFNGSQTFVDTNTTHEIRYGTGFAKLEYGYDYVQIGSAKISQQMFGVATDSEFASAGILGAAPQLKGWKSDYPLVLDNLAAQGFIKSRAFSLDIRSIASKRGSVVFGGIDTKKFSGHLEKRPIIPATESPDKLTRYWIYLDGVSVTKEDGSKAVIFDQANGQPVLLDSGYTVSALPTRHFNKIKDAFPGVSAPPEDDKSGLYRVPCDVGSKNGSVNFKFGKTEIVVPYDDFIWKQPENNLCVLGVTPDDEFPVLGDTFLRGAYAVYDQDNRNIHLANNEDCGSSLVAIGTGPDAVPSVEGDCGRPEPTTTSTHSKTTLATIPTGNSTISSAKHTTSSSSVVSPTSTHSTTSSAAIPTAHNSSVIPSAKSTASSSSTASLTIPATRNSTVISAKPTTASTLVSTGHEDNTVLTTSKLISTTSKPISITSKSTSTTSNPLPTGTEQNTTVPVTHTSTFTTTSVHTILSCPPYVTGCPIGSVTTETITGVTTWCPGNTAPSAKPPQTTETKTPPPATVITVQPTVTSAPSITSVFTTTKTHAITSCSEQASCNKGHVTTEVVTSTTYLCPESTATFTIPRTHTCREGDNGCRSGDVVTTVFTVTVEPQPTADKPTPVPGCGDNCVLPPPAQTRPAAETTAAETQPSITAIITAPGPVPTVPGTNGTITTTSKPGDTPCSTCSPETTSTPMTAGASGFRIPIMAVAMIVGALTVIL

SEQ ID NO: 527 - protein, 811 aa, Gibberella zeae
MLSTLFLAVAAPALATAFNAPNVPVGTDDSSPDGLIRFPLKVSTGAPVVKGVTKRQNEVALESQQNGFFYSIDVTLGTPGQKVTVNLDTGSAELWVNPVCEKAQQPAFCKQFGHFGESSTFVDLNTTGGVVYGTGYAYWNYGYDNVVVGSAAIRNQVFGVAYDSSFTGVGIMGAGPDLNGWDAPYPLVIDSMVKQGLIKSRALSLDIRTINSDRGAVIFGGIDTAKYTGRLQKLPIIPAASSPDGLTRYWVSLDGISLVQEDGTVDSAFSGSTPQPVLLDSGYTVSALPGSIFNKIVAAFPTAKSNGGAYVDVDCSVADIKGSVDFKFGDKTIKVPYADFIWHNDDRCVLGVFQDDEFPVLGDTFLRAAYVVYDWDNRNVWIANNEDCGTNLVAIGTGPDAVPDLVGQCGSDSETTTSASETASATETETETETASATESEAVTATTEDVTSAETDTTTGYFPTTRYSNSTASVTGKGTSTTKKATGGSGESYELPSYTDSSASTTITSTVVTSKVYTVTACPPSVTNCPVGQVTTETITSLTTYCPGSDDSSSHSTTVEGEGATHPTGAVHLTSYVTATNMHTITSCPGEGACHTSVITEIVHNTQIASPEEPTGIFTIPEAIQCGAGNFGCKEATTKGYRTVTITPVVKAPKPTPVPGYCATCGPLKGHGHHNDDDKETATGGYTAPGKQTGGYDQPTQAHPGQDYPRPTGGDSPKPTGDSHNPTGDSDKPSGDAPKPNPLEELHTYRPTNVFPQIPSSVATVVKPTGTPQAGGPSEPAGTPPVVINGASGWNVPVVAAVVVGAFVAAL

SEQ ID NO: 528 - protein, 668 aa, Myceliophtora thermophila
MSFALYAAALLPVAVLGAGLSVPEDNRMVQQDGLLRYPLMPRLGNLLFGKHANITRRQIDTGIFDPLSGTLYTIELTLGTPGQTVPVQFDTGSDMLWVNPVCSKAAEPEFCAAQPRFTDSSTLVDFGEQGNITYGTGYAYYEYVADYVAIGSARITQQVFGVALDSAHADVGIFGAGPNLDGWDSAYPLVVDSLAQQGYTSSRAFSMDLKGFESARGSVIFGGIDTKKYRGSLIKRLIIPAAESPDGYTRFWIYLDGISVNQPDGDVVTVFSTPDGGKGQPVLLDSGYTLSALPRPIFQKLVAAFPSAQYVSSADVYVVDCVDHGEGGSLDFIFGGKTINVPYHEFVWAQPESNTCVLGAFEDDFPVLGDTFLRSAYVVYDWDNRNIYLAQSDDCGSNLVAIGSGPDAVPSIVGECGKPKPTSTSTFSKTSSKTSTASKTSSTSDSTSSSSSHVTTSSSSTTATTLSTHKPPFPTASGNFTTTRSPTTTTASSTISKSTLTITSATTYTITSCPPTVTRCPAHEVTTEIITKTTAVCPETTATYTIPRTITCPGSGGGDDCPPGATRTTTLTVTLSPVGPTDRTTHVVPGVTTTTPTTITAPPTGQTTTTLVPALPPTTTTMSGHRGINGTVTATSKPPAVTAGSAKVGLVSGATAIVAGVMAVLMAL

SEQ ID NO: 529 - protein, 551 aa, Neurospora crassa
MLPVPLTTLSLYVVALLSPPAAAGVLASATTKLPIKLPISPAQGHRSSTAASPSLTSRSSSSGNGFIRASVHAAHGAPPKLRRRQEDEGLKNQNLGTTYTIDIDIGTPPQTVTLILDTGSPDLWVNPQCETSGQEKYCNSFRQFDYTKSKTIQDTGAADILKYGKGNVTIEYVTDDVIIGSAKIKSQILGIGFESIDIPLGILGLSPSVSPDGTSPYPYLLDSMASQGIISSRAFSLDLRSIDNPSGAIIFGGVDLGKFSGSLAKLPMLDPSQTPAGVDRYWIVLSGVGMTYPDGEEVESEEIGVPVFLDSGGTLSRLPETIFQAIGDSFPGSQYDPESGFYIVDCAVAEQAGSVDFIFGSSGSRSSKKIRVPYGDFVWEVQTGVCVVGVLPTDDEPVFGDSFLRAAYVVFDQDNRNLHLAQAANCGEQIVEIGSGQDAVPSSTGKCKDGSAGSTKTAGGGGLDVTATRAPTRTAGGSGPAVTNSDFGPGPAGTRVSTGGIGLPTGTGGGGGSGDGNGNNDDDDSAASGLDVGVTAAAVLAGLNMLIVWLL

SEQ ID NO: 530 - protein, 477 aa, Trichoderma reesei
MRFVQYVSLAGLFAAATVSAGVVTVPFEKRNLNPDFAPSLLRRDGSVSLDAINNLTGGGYYAQFSVGTPPQKLSFLLDTGSSDTWVNSVTADLCTDEFTQQTVGEYCFRQFNPRRSSSYKASTEVFDITYLDGRRIRGNYFTDTVTINQANITGQKIGLALQSVRGTGILGLGFRENEAADTKYPTVIDNLVSQKVIPVPAFSLYLNDLQTSQGILLFGGVDTDKFHGGLATLPLQSLPPSIAETQDIVMYSVNLDGFSASDVDTPDVSAKAVLDSGSTITLLPDAVVQELFDEYDVLNIQGLPVPFIDCAKANIKDATFNFKFDGKTIKVPIDEMVLNNLAAASDEIMSDPSLSKFFKGWSGVCTFGMGSTKTFGIQSDEFVLLGDTFLRSAYVVYDLQNKQIGIAQATLNSTSSTIVEFKAGSKTIPGPASTGDDSDDSSDDSDEDSAGAALHPTFSIALAGTLFTAVSMMMSVL

SEQ ID NO: 531 - protein, 470 aa, Trichoderma virens
MRSSVQYISLAGLIAAGTVSAGIVSIPLEKRYIINDPAPSLLRRDGSISLDALNNITGGGYYAEFSIGTPPQKLSFLLDTGSSDTWVNSVKADLCTSPSVQQTVGEYCYKQFNPSSSSSYKSSTEDFDIKYLDGRRIQGTYFKDTVTINGASIKSQQLGLALVSVRGTGIMGLGFTDNVAADVKYPTIIDNMVSQNVIPVPAFSLYLNDLQTSQGAILFGGVDTDKFHDGLATLPLQPLPANVATTQEIVMYNVQLNGFTASGVDTPAVNGSAILDSGSTLTLLPDAVAQSLWKKYGVINLQGLPIPFVDCGKANTKDATFNFKFTNKTIKVPIDEMVINNLASIQGEIMSDPTLSSLFKGWSGVCTFGISSTRNYGIRTDNFILLGDTFLRSAYVVYDLQNKQIGIAQATLNSTTSSIVEFQKGSKTIPGPVSTGADDSGSAGSAIYPTFSIALAGTVFTALSMMLSAL

SEQ ID NO: 532 - protein, 480 aa, Trichoderma atroviride
MRSTLQYASLAALVAAGTASAGVVSVPFEKRFLDSNPLPSLLRRDGTVALDALNNITGGGYYAEFSVGTPPQKLSFMLDTGSSDTWVNSVDADLCTDSIIQEEVGEFCSKQFDQTKSKSFNSTRQLFNITYLDGRNIRGRYFKDTVTINNAAIKNQQMGLALESVRGTGLMGLGFRSNEAAAIKYPTVIENMVSQKIIAMPAFSLYLNDLQTSQGSILFGGVDTDKFHGGLATLPFQSLPASVSRTSDIVMYAVQLNGLKVSGVDTPSVNATAVLDSGSTISLLPGDVVQAVWKEFGVMNVQGVPNPFVDCAKANLKDTSLSFQFTNKTIQVPIDEMVINNLASVQDQIFSDPTLKQVFKGWSGVCTFGMASTSDFGISSDQFVLLGDTFLRSAYVVYDLQNQQVGIAQATLNSTSSSIIEFQAGSKSIPGPVSTGSDDSSSDDGDSSGKDNAGVALHPAFSAAIAGTLFVTLSMIMTAL

SEQ ID NO: 533 - protein, 461 aa, Fusarium pseudograminearum
MRTFTILASLTIGASAGTVSAPFVKHGFHYGASIDKRDTLNLEALNNITGGGYYAEFQIGTPPQNISFLLDTGSSDTWVNSNNTDLCHSQAAQKKNGYCMTTFKPENSRTFKVVDRDGFDIRYLDTRRIEGDYFNDTVTIDGKTVKQQQLGLAIKSVRPTGIMGLGFSANVATNKSYPAIVDNMVSQGLIDTATYSLWLNDLDSDQGTILFGGIDTKRFYGKLATLPLLPESTKSLNVTSFSVSLQGLNVKTPKNSNGIKMDSLKKNTVAILDSGSTVCLLPDPQVNEIYKAFDVLSVQDVPIPFVDCGYGKDKGKGISFDFEFDGKTISIPMSEMIVNAFPDNQDLFKDPRLDIYFKDWDGVCMFGISPASTYGIGTSKFAILGDTFLRSAYVVYDLANEQVGIAEAYHSNNESSVVELKANSKLPDVSGVPEPQNAAGHVSPASLVTLIVATGIALTLL

SEQ ID NO: 534 - protein, 482 aa, Gibberella zeae
MRTFTILASLTIGASAGTVSAPLVKHGFHYGASIDKRDTLNLEALNNITGGGYYAEFQIGTPPQNISFLLDTGSSDTWVNSNNTDLCHSQAAQKKNGYCMTTFKPEKSRTFKVVDRDGFDIRYLDTRRIEGDYFNDTVTIDGKTVKQQQLGLAIKSVRPTGIMGLGFSANVATNKSYPAIVDNMVSQGLIDTAAYSLWLNDLDSDQGTILFGGIDTKRFYGKLATLPLLPESTKSLNVTSFSVSLQGLNVKTPKNSNGIKMDSLKKNTVAILDSGSTVCLLPDPQVNEIYKAFDVLSVQDVPIPFADCGYGKDKGKGISFDFEFDGKTISIPMSEMIVNAFPDNQDLFKDPRLDIYFKDWDGVCMFGISPASTYGIGTSKFAILGDTFLRSAYVVYDLANEQVGIAEAYRSNNESSVVELKANSKLPDVSGVPEPESAAGHVSPASLVTLIVAAGITLTLLKDLRHLCYCSYCSPNCYTVPA

SEQ ID NO: 535 - protein, 482 aa, Metarhizium anisopliae
MPSLHHVALVLGAVATVSAGTLSVPLERRGPSEEHYRLLGRAISRRAADNGTAELTALNNITAAGYYANFAIGTPGQNLTFQLDTGSSDTWMNSPQTRYCRSATAQSEAGYCTTTFNPRDSKTYTLVDQGGFNITYLDQRRITGDYFNDTVTIGGHEIANQQLGLAISSTRPTGIMGLGFSINVATPNKYPTIIDNMVSEGVIAHPSFSLYLNDLDATSGTILFGGIDSAKFLGSLATLPIKPMPNAEDTNVTSYAVAIKSVSATGVKVPSVAPQSVGILDSGSTISLIPDSLVKPIQDKFGVIVVQIQGQAAPPMIDCAWKGSKGDGILISFEFDNKTIKVPIADMAIDSLPDELQQILKSNDAPSGFRSWTRACLFGLGGSSAFGVRDDQFYLLGDTFLRSAYVAYDMANQQIGLAQSNPNATGSNVVEIQKDAKSFPNVQGSDAPGPGEKASASGRLAPSSSVAATLLLGVAVVFSALL

SEQ ID NO: 536 - protein, 529 aa, Neurospora crassa
MKSTLATLLALASVAVAENGVVNFPLNRGVPHFRVGNVRQNVKRDTYSQALINNITGGAYYAEVTVGTPGQKVSVVLDTGSSDLWVVSYKADLCTDPSIQRQWGDSCDKTYNPTKSSSYKVLEEDSFEIRYLDNSTAAGDYITDDLNIGGATIKSLQMGYATKTVRGAGILGVGYSSNVASQQRYPNLIDQFVAQKLITTKAYSLYLNDRRSDTGSILFGGIDKDKFIGDLSILPIYLAKGQAEPIHFEVEMQSVSLALTKNGKTTKIISTDPSLSQTSTIAILDSGTTLSYLPSKITDQIHTKLSVYVDEIWTGLTFIDCQYLTSNPDLRLSFTFGANATISVPVWELVLDLLGESQSELPFKMPFKNACIFGIQSTAGFQEDNFDEDWALLGETFLRSAYVVYDLTHHQIGIAQANLNSTTTDIVELSGADGGLPTGLTGVKEQQTSNDPSGNAGSGSGSSTDKDGAKETETVTAGSTAATGTAASGAKETDSAAAGLSARGGAVGALAVASLTGFLALVGGAVVAL

SEQ ID NO: 537 - protein, 566 aa, Myceliophthora thermophila
MKPSSAILLALAPGSSSKNVVEFSVSRGLPGNRTPLSFPPLTRRETYSERLINNIAGGGYYVQVQVGTPPQNLTMLLDTGSSDAWVLSHEADLCISPALQDFYGMPCTDTYDPSKSSSKKMVEEGGFKITYLDGGTASGDYITDHFTIGGVTVQSLQMACVTKAVRGTGILGLGFSISERASTKYPNIIDEMYSQGLIKSKAFSLYLNDRRADSGTLLFGGIDTDKFIGPLGVLPLHKPPGDRDYSSFEVNFTSVSLTYTNGSRHTIPTAILNHPAPAVLDSGTTLSYLPDELADPINTALDTFYDDRLQMTLIDCSHPLLRTDPDFHLAFTFTPTTSITVPLGDLVLDILPPTYPQSNSNNNNEVEDDDDDDDDDDDDDKVPPATERRWCVFGIQSTTRFAASSGQSEANFTLLGDTFLRSAYVVYDLSHYQIGLAQANLNSSSSSTNTNTIVELTADNHDDGASERGEGAGAGADAGTRTVIAGGLPSGLMGVEAQQTTFTPTATANGHPGYGGGPGGSTRPGSERNAAAGGFTAVRTGLLGELVGVAAVTALFILLGGALIAV

SEQ ID NO: 538 - protein, 249 aa, Aspergillus nidulans
MKTAVKTTALLSLLSTAMADKAIVGGDDAEITEYPYQIALLSGGSLICGGSIISSKYVVTAGHCTDGASASSLSIRAGSTYHDKGGTVVDVEAITVHPEYNANTVDNDISILELAEELQFGDGIKAIDLPSSSSLPSEGTIGTATGWGALTEGGNVSPNLQYVEVPVVSKSQCSSDYSGFNEITASMFCAGEEEGGKDGCQGDSGGPFAADGVLIGITSWGNGCARAGYPGVYSSPAYFRDFIQQVTGL

SEQ ID NO: 539 - protein, 897 aa, Myceliophthora thermophila
MVRLDWAAVLLAATAVAKAVTPHTPSFVPGAYIVEYEEDQDSHAFVNKLGGKASLRKDLRFKLFKGASIQFKDTETADQMVAKVAEMPKVKAVYPVRRYPVPNHVVHSTGNVADEVLVKRQAAGNDTFSTHLMTQVNKFRDAGITGKGIKIAVIDTGIDYLHEALGGCFGPDCLVSYGTDLVGDDFNGSNTPKPDPDPIDNCQGHGTHVAGIIAAQTNNPFGIIGAATDVTLGAYRVFGCNGDTPNDVLIAAYNMAYEAGSDIITASIGGPSGWSEDPWAAVVTRIVENGVPCVVSAGNDGDAGIFYASTAANGKKVTAIASVDNIVTPALLSNASYTLNGTDDFFGFTAGDPGSWDDVNLPLWAVSFDTTDPANGCNPYPDSTPDLSGYIVLIRRGTCTFVEKASYAAAKGAKYVMFYNNVQQGTVTVSAAEAKGIEGVAMVTAQQGEAWVRALEAGSEVVLHMKDPLKAGKFLTTTPNTATGGFMSDYTSWGPTWEVEVKPQFGTPGGSILSTYPRALGSYAVLSGTSMACPLAAAIYALLINTRGTKDPKTLENLISSTARPNLFRLNGESLPLLAPVPQQGGGIVQAWDAAQATTLLSVSSLSFNDTDHFKPVQTFTITNTGKKAVTYSLSNVGAATAYTFADAKSIEPAPFPNELTADFASLTFVPKRLTIPAGKRQTVTVIAKPSEGVDAKRLPVYSGYIAINGSDSSALSLPYLGVVGSLHSAVVLDSNGARISLASDDTNKPLPANTSFVLPPAGFPNDTSYANSTDLPKLVVDLAMGSALLRADVVPLSGGAATATARLTRTVFGTRTIGQPYGLPARYNPRGTFEYAWDGRLDDGSYAPAGRYRFAVKALRIFGDAKRAREYDAAETVEFNIEYLPGPSAKFRRRLF

SEQ ID NO: 540 - protein, 534 aa, Myceliophthora thermophila
MRGLVAFSLAACVSAAPSFKTETINGEHAPILSSSNAEVVPNSYIIKFKKHVDESSASAHHAWIQDIHTSREKVRQDLKKRGQVPLLDDVFHGLKHTYKIGQEFLGYSGHFDDETIEQVRRHPDVEYIERDSIVHTMRVTEETCDGELEKAAPWGLARISHRDTLGFSTFNKYLYAAEGGEGVDAYVIDTGTNIEHVDFEGRAKWGKTIPAGDADVDGNGHGTHCSGTIAGKKYGVAKKANVYAVKVLRSNGSGTMADVVAGVEWAAKSHLEQVQAAKDGKRKGFKGSVANMSLGGGKTRALDDTVNAAVSVGIHFAVAAGNDNADACNYSPAAAEKAVTVGASAIDDSRAYFSNYGKCTDIFAPGLSILSTWIGSKYATNTISGTSMASPHIAGLLAYYLSLQPATDSEYSVAPITPEKMKSNLLKIATQDALTDIPDETPNLLAWNGGGCNNYTAIVEAGGYKAKKKTTTDKVDIGASVSELEKLIEHDFEVISGKVVKGVSSFADKAEKFSEKIHELVDEELKEFLEDIAA

SEQ ID NO: 541 - protein, 497 aa, Aspergillus niger
MKGILGLSLLPLLTAASPVFVDSIHNEAAPILSATNAKEVPDSYIVVFKKHVTSELASAHHSWVQDIHDSQSERTELKKRSLFGLGDEVYLGLKNTFDIAGSLIGYSGHFHEDVIEQVRRHPDVDYIERDSEVHTMEGATEKNAPWGLARISHRDSLTFGNFNKYLYASEGGEGVDAYTIDTGINVDHVDFEGRATWGKTIPTNDEDLDGNGHGTHCSGTMAGKKYGVAKKANLYAVKVLRSSGSGTMSDVVSGVEYAVQAHIKKAKDAKNGKVKGFKGSVANMSLGGGKSKTLEDAVNAGVEAGLHFAVAAGNDNADACNYSPAAAEKAITVGASTLADERAYFSNYGECTDIFAPGLNILSTWIGSNYATNIISGTSMASPHIAGLLAYFVSLQPPSDSAFAVEELTPAKLKKDIIAIATEGALTDIPSNTPNLLAWNGGGSENYTDIVGSGGYKVSSAKNRIEDRIEGLVHKAEELLTEELGAIYSEIQDAVVA

SEQ ID NO: 542 - protein, 495 aa, Aspergillus oryzae
MRGILGLSLLPLLAAASPVAVDSIHNGAAPILSASNAKEVPDSYIVVFKKHVSAETAAAHHTWVQDIHDSMTGRIDLKKRSLFGFSDDLYLGLKNTFDIAGSLAGYSGHFHEDVIEQVRRHPDVEYIEKDTEVHTMEETTEKNAPWGLARISHRDSLSFGTFNKYLYASEGGEGVDAYTIDTGINIEHVDFEDRAHWGKTIPSNDEDADGNGHGTHCSGTIAGKKYGVAKKANIYAVKVLRSSGSGTMSDVVLGVEWAVQSHLKKAKDAKDGKVKGFKGSVANMSLGGGKSRTLEAAVNAGVEAGLHFAVAAGNDNADACNYSPAAAENAITVGASTLQDERAYFSNYGKCTDIFAPGLNILSTWTGSKHAVNTISGTSMASPHIAGLLAYFVSLQPAQDSAFAVDELTPAKLKKDIISIATQGALTDIPSDTPNLLAWNGGGADNYTQIVAKGGYKAGSDNLKDRFDGLVNKAEKLLAEELGAIYSEIQGAVVA

SEQ ID NO: 543 - protein, 494 aa, Penicillium chrysogenum
MKGFLSLTLLPLLVAASPVAVNSIHNDAAPILSSMTSKDIPDSYIVVFKKHVDPSSASAHQSWLQEVHTAHTGRMELKKRSLFGFDFEAFMGLKHTFHIAGSLLGYAGHFHEDVIEQIRRHPDVDYIEKDSEVRTMSEGSVEKNAPWGLARISHRESLSFGNFNKYLYAEEGGEGVDAYVIDTGANVKHVDFEGRANWGKTIPQGDADEDGNGHGTHCSGTIAGKKFGVAKKANVYAVKVLRSNGSGTMSDVVKGVEWAAEAHIKKSKKGDKKFKGSVANMSLGGGSSRTLDLAVNAAVDAGIHFAVAAGNDNADACNYSPAAAEKAITVGASTLADERAYFSNYGKCTDIFAPGLNILSTWVGSDHATNTISGTSMASPHIAGLLAYYVSLAPAKDSAYAVADVTPKQLKAALISVATEGTLTDIPSDTPNLLAWNGGGSANYTKILADGGYKAHNAETTVEDRIGGIIDSAEKAFHKELGAIYSEIKDAVSA

SEQ ID NO: 544 - protein, 477 aa, Aspergillus nidulans
MKGIFGLSLLPLLVAASPVVVDSIHNGAAPILSSTNAKEVPDSYIVVFKKHVDPVAASVHHSWVQDIHGQKSGGRADLKKRFLGLEFGFGEEIYDGLKATFNIAGSLMGYSGHFHEDTIEEIRKHPDIEYIERNSEVHTLEDTDVEKNAPWGLARISHRDRLTFGTFNKYLYASEGGEGVDVYTIDTGINIEHEDFEGRAFWGKTIPNNDADEDGNGHGTHCSGTIAGKKYGVSKKANIYAVKVLRSSGSGTMADVVQGVEWAVESHLKKAKKGGNGFKGSVANMSLGGGKSKTLEDAVNAGVEAGVHFAVAAGNDNADACSYSPAAAEKAVTVGASTLADERAYFSNYGKCTDIFAPGLNILSTWIGSKSAVNTISGTSMASPHIAGLLAYFVSLQPSKDSAFAVDFTPEKLKKDIISIATEGVLTDIPADTPNLLAWNGGGSTNYSDIIAKGGYKSGSHVDSTPFKAGGILAQAM

SEQ ID NO: 545 - protein, 396 aa, Neurospora crassa; identical to SEQ ID NO: 179

SEQ ID NO: 546 - protein, 392 aa, Myceliophthora thermophila
MHFSTALLAFLPAALAAPTAETLDKRAPILTARAGQVVPGKYIIKLRDGASDDVLEAAIGKLRSKADHVYRGKFRGFAGKLEDDVLDAIRLLPEVEYVEEEAIFTINAYTSQSNAPWGLARLSSKTAGSTTYTYDTSAGEGTCAYVIDTGIYTSHSDFGGRATFAANFVDSSNTDGNGHGTHVAGTIGGTTYGVAKKTKLYAVKVLGSDGSGTTSGVIAGINFVADDAPKRSCPKGVVANMSLGGSYSASINNAAAALVRSGVFLAVAAGNENQNAANSSPASEASACTVGATDRNDAKASYSNYGSVVDIQAPGSNILSTWIGSTSATNTISGTSMASPHIAGLGAYLLALEGSKTPAELCNYIKSTGNAAITGVPSGTTNRIAFNGNPSA

SEQ ID NO: 547 - protein, 403 aa, Aspergillus nidulans
MHSFKRSLLLLGALLPAVFGAPVEPRRAAEKVPGKYIVTFKSGLNVDQIDAHTSWASNVHKRNLERRGLAERDQYSGIEKNYKINKFAAYSGSFDDATIEEIRNSADVAHVEEDQIWYIDALTSQSGAPWGLGAISHKGEASTTYVYDTSAGEGTYAYVVDTGINADHEEFGGRASLAYNAVGGQHVDSVGHGTHVAGTIGGETYGVSKKANLLSVKVFQGESSSTSIILDGFNWAANDIVSKGRTGKSAINMSLGGGYSYAFNQAVEDAYDEGVLSVVAAGNDNIDASDSSPASAPNALTVAASTKSNTRASFSNYGSVVDIFAPGQDILSAWIGSTTATNTISGTSMATPHVVGLSLYLIALEGLSSASAVVSRIKELATQGVLSNVQGSPNLLAYNGADE

SEQ ID NO: 548 - protein, 420 aa, Myceliophthora thermophila
MAGRLLLCLTAALSALGVSAAPAPDASGRPFIGVPVSNPGIANAIPNRYIVVYNNTFNDEDIDLHQSNVIKTIAKRNIAKRSLTGKLLSTTVNTYKINNWRAMALEADDATINEIFAAKEVSYIEQDAVISLNVRQMQSQATTGLARISHAQPGARTYIFDSSAGEGITAYVVDTGIRVTHEEFEGRATFAANFIDDVDTDEQGHGSHVAGTIGGKTFGVAKKVNLVAVKVLGADGSGSNSGVIAGMQFVASNATAMGLKGRAVMNMSLGGPASRAVNSAINQVEAAGVVPVVAAGNESQDTANTSPGSAEAAITVGAIDQTNDRMASFSNFGELVDIFAPGVNVQSVGIRSDTSTNTLSGTSMASPHVAGLAAYIMSLENITGVQAVSDRLKELAQATGARARGVPRGTTTLIANNGFA

SEQ ID NO: 549 - protein, 398 aa, Penicillium chrysogenum
MGFLKVLATSLATLAVVNAGKLLTGSDAGAVVPGSYIVVMNDGVSNDVFKNHRDWAATVHARIASRKGGESGPGKNFDINGMKGYTASFDDRTVKDIASDPAVKYVEPDMVVNATENVVQPNAPSWGLPRISSQKPGATDYVYDSTAGEGIVVYGVDTGIDIRHSDFEGRAEWGTNTVDNDNTDGNGHGTHTASTAVGSKFGVAKKASVVAVKVLSADGSGTNSQVIAGMEWAVKDAKSRGVTGKSVMNMSLGGAFSRAMNDAAANVVKSGVFLSVAAGNEAQDASNSSPASAPNVCTIAASTSSDRSASFSNFGSVVDLYAPGESITAAYPGGGSKTLSGTSMAAPHVAGAAAYLMALEGVASDKACARIVELAISSISSAPFGTTSKLLFNGLNAK

SEQ ID NO: 550 - protein, 421 aa, Neurospora crassa
MVGLKNVALFAASIILPASITWAAPIIEVETKPIPEKYIVLLKPHADLEGHLSWAKDVHARSLSRRDTAGVHKAWSVGSKFKAYAGEFDEETLKIIQRDERNVHSIEPDKSWRLYKSNKKDNDDSNSDNTTIITQKQAPWGLGYLSHKGKTSSDYVYNSTAGTGTYAYVVDTGCWKDHVEFEGRVQLGYNAYPDSPFIDMDGHGTHVTGTLISKTYGVAKNATVICVKVFHGGGSANTIVMDGFEWAVKDIIAKKRQRNSVINMSLGCDRSEAFNAIVDAAYDQGILTVVAAGNENQPAALVSPASSARAFSVGAIDNKNTRAYFSNYGAIVDIFAPGVNIVSTYIGKKDGDNNRTMTMSGTSMASPHVAGLALYLKSLDPEKYGNSSDAHSGLRALGVPDKVWDAGEMSPNLVAYNGVQG

SEQ ID NO: 551 - protein, 658 aa, Aspergillus nidulans
MAATGRFTAFWNVASVPALIGILPLAGSHLRAVLCPVCIWRHSKAVCAPDTLQAMRAFTRVTAISLAGFSCFAAAAAAAFESLRAVPDGWIYESTPDPNQPLRLRIALKQHNVAGFEQALLDMSTPGHSSYGQHFGSYHEMKQLLLPTEEASSSVRDWLSAAGVEFEQDADWINFRTTVDQANALLDADFLWYTTTGSTGNPTRILRTLSYSVPSELAGYVNMIQPTTRFGGTHANRATVRAKPIFLETNRQLINAISSGSLEHCEKAITPSCLADLYNTEGYKASNRSGSKVAFASFLEEYARYDDLAEFEETYAPYAIGQNFSVISINGGLNDQDSTADSGEANLDLQYIIGVSSPLPVTEFTTGGRGKLIPDLSSPDPNDNTNEPFLDFLEAVLKLDQKDLPQVISTSYGEDEQTIPEPYARSVCNLYAQLGSRGVSVLFSSGDSGVGAACQTNDGKNTTHFPPQFPASCPWVTAVGGTNGTAPESGVYFSSGGFSDYWARPAYQNAAVESYLRKLGSTQAQYFNRSGRAFPDVAAQAQNFAVVDKGRVGLFDGTSCSSPVFAGIVALLNDVRLKAGLPVLGFLNPWLYQDGLNGLNDIVDGGSTGCDGNNRFNGSPNGSPVIPYAGWNATEGWDPVTGLGTPDFAKLKALVLDA

SEQ ID NO: 552 - protein, 601 aa, Penicillium chrysogenum
MIASLFNRGALSLAVLSLLASSASADVFESLSAVPQGWRYSRRPRADQPLKLQIALAQGDTAGFEEAVMDMSTPDHPSYGNHFHTHEEMKRMLQPSAESADSIRDWLESAGINRIEQDADWMTFYTTVETANELLAANFQFYANSAKHIERLRTLQYSVPEALMPHINMIQPTTRFGQLRVQGAILHTQVKETDEAFRSNAVSTSPDCNSIITPQCLKNMYNVGDYQADDDNGNKVGFASYLEEYARYSDLELFEKNVAPFAKGQNFSVIQYNGGLNDQHSSASSSEANLDLQYIVGVSSPVPVTEFSVGGRGELVPDLDQPDPNDNNNEPYLEFLQNVLKMEQQDLPQVISTSYGENEQSVPEKYARTVCNLFSQLGSRGVSVIFASGDSGVGAACQTNDGRNATRFPAQFPAACPWVTSVGATTHTAPEKAVYFSSGGFSDLWDRPKWQEDAVSDYLDTLGDRWSGLFNPKGRAFPDVSAQGQNYAIYDKGSLTSVDGTSCSAPAFAGVIALLNDARLKANKPPMGFLNPWLYSTGRDGLNDIVHGGSTGCDGNARFGGPGNGSPRVPGASWNATKGWDPVSGLGSPNFATMRKLANGE

SEQ ID NO: 553 - protein, 588 aa, Aspergillus niger
MIYVNYILGLLSLLHTAVATAPDYVVVDQLNSIPDGWTKGAAPPPFTPMKFWLSMHHEYKADFEQKVIDISTPGHRDYGRHMKRNDVMAFMRPSDQVSKIIFSWLESEHVPPNAIEDRGDWVAFTVPLAQAQSMMKTDFYNFHHLETNTTQIRTLKYSVPEQVDAHLQMIQPTTRFGRPKTQTSLPSLMPVSVNIDEISEDCLTGVTPICLRQLYGLPSTKASPDSRNVLGISGYLDQYARYSDLDEFLAVYSPNSVDADFSVVSINGGQNPQNSQEGSTEASLDIQYALSMAFDANATFYTTAGRAPSVSDSGTVSTDGSTNEPYLEQLQYLVGLPDEDLPAVLSTSYGEDEQSLPEEYTEATCNLFAQLGARGVSVIFSSGDSGVGGSCVSNDGSQRTRFQPIFPASCPFVTSVGGTEGVGPEKAVDFSSGGFSERFARPSYQNASVEAYLARLGDKWDGLYNPDGRGIPDVSAQASNYVIRDHGQWLQTAGTSAAAPVFAAVISRLNAARLEQGKPTLGFLNPWLYSLDQQGFTDIVDGGSVGCDGSNGGALVPYASWNATKGWDPVTGLGTPLYQTLEQLAQSA

SEQ ID NO: 554 - protein, 600 aa, Aspergillus oryzae
MFFSRGALSLAVLSLLSSSAAGEAFEKLSAVPKGWHYSSTPKGNTEVCLKIALAQKDAAGFEKTVLEMSDPDHPSYGQHFTTHDEMKRMLLPRDDTVDAVRQWLENGGVTDFTQDADWINFCTTVDTANKLLNAQFKWYVSDVKHIRRLRTLQYDVPESVTPHINTIQPTTRFGKISPKKAVTHSKPSQLDVTALAAAVVAKNISHCDSIITPTCLKELYNIGDYQADANSGSKIAFASYLEEYARYADLENFENYLAPWAKGQNFSVTTFNGGLNDQNSSSDSGEANLDLQYILGVSAPLPVTEFSTGGRGPLVPDLTQPDPNSNSNEPYLEFFQNVLKLDQKDLPQVISTSYGENEQEIPEKYARTVCNLIAQLGSRGVSVLFSSGDSGVGEGCMTNDGTNRTHFPPQFPAACPWVTSVGATFKTTPERGTYFSSGGFSDYWPRPEWQDEAVSSYLETIGDTFKGLYNSSGRAFPDVAAQGMNFAVYDKGTLGEFDGTSASAPAFSAVIALLNDARLRAGKPTLGFLNPWLYKTGRQGLQDITLGASIGCTGRARFGGAPDGGPVVPYASWNATQGWDPVTGLGTPDFAELKKLALGN

SEQ ID NO: 555 - protein, 587 aa, Neurospora crassa
MLWSVLLLAAGASAHVKSSLPSVPSGWKKVRAASADESVSLKIALPAHQPDALETAILRVSDPNHHEYGMHLSSEEVRSLVAPADETTDAVTSWLNRNGIKGKVDNDWVSFTTSVAKANNLLNTTFDWYQQDGDKTGPKLRTLQYSVPDELDAHVDMIQPTTRFGKLAAKASTIFEIFDEPEPKNIANVKVGGDHPTCTGCIYPDEIRSLYNIKYKPSASDKNTIAFASYLEQYSNYDDFTSFAKAFIPDAADRNYTVKLVKGGLHDQSPDKIGVEANLDLQYILAISNPIPIREYSIGGRGPLVPTANQPGPEISNEPYLDFFQYLLSLKNSELPATLSTSYGEEEQSVPREYALKVCSMIGQLGARGVSVIFSSGDSGPGDACIRNDGTNSTYFEPTFPGACPWVTSVGGTYQTGPEKAVDFSSGGFSMYHKRPVYQERVVKKYLDKIGDTYSDFFDEQGRGFPDVSAQASRYAVYVDGRLVGVSGTSASAPMFAGLVALLNAARKSHGLPSLGFINPLLYASKDAFTDIVNGAGTGCRGRPEFAGDVGGTAKWNATEGWDPVTGLGTPKFDKLLALAAPGVKNA

SEQ ID NO: 556 - protein, 644 aa, Aspergillus fumigatus
MRLSHVLLGTAAAAGVLASPTPNDYVVHERRAVLPRSWTEEKRLDKASILPMRIGLTQSNLDRGHDLLMEISDPRSSRYGQHLSVEEVHSLFAPSQETVDRVRAWLESEGIAGDRISQSSNEQFLQFDASAAEVERLLGTEYYLYTHQGSGKSHIACREYHVPHSLQRHIDYITPGIKLLEVEGVKKARSIEKRSFRSPLPPILERLTLPLSELLGNTLLCDVAITPLCISALYNITRGSKATKGNELGIFEDLGDVYSQEDLNLFFSTFAQQIPQGTHPILKAVDGAQAPTSVTNAGPESDLDFQISYPIIWPQNSILFQTDDPNYTANYNFSGFLNTFLDAIDGSYCSEISPLDPPYPNPADGGYKGQLQCGVYQPPKVLSISYGGAEADLPIAYQRRQCAEWMKLGLQGVSVVVASGDSGVEGRNGDPTPTECLGTEGKVFAPDFPATCPYLTTVGGTYLPLGADPRKDEEVAVTSFPSGGGFSNIYERADYQQQAVEDYFSRADPGYPFYESVDNSSFAENGGIYNRIGRAYPDVAAIADNVVIFNKGMPTLIGGTSAAAPVFAAILTRINEERLAVGKSTVGFVNPVLYAHPEVFNDITQGSNPGCGMQGFSAATGWDPVTGLGTPNYPALLDLFMSLP

SEQ ID NO: 557 - protein, 645 aa, Aspergillus oryzae
MKTSFLLLHTLVAGVLAIPTRTDYVLHERRDAVPAHWTGEKRLDGQTVLPMRIGLTQSNLDRGHDLLMEVSTPGSPRYGDHMTLDEVHNLFAPSQDSVDSVRSWLESAGISPDRISQSTNKQWLQFDAGVDEVEQLLKTEYYRYSHAGTGRSHVACREYHVPESVQSHIDYITPGIKHLEIREEKPVEKRSLDKRSFGILPPILRPLTLPLEELLGQLLLLCDVAVTPACIQAMYNVTDGDKATKGNELGIFEDLGDVYSQDDLDLFFSTVAHKIPTGTHPILNAIDGAQAPADTTNAGTESDLDFEISYPLIWPQNSILFQTDDPIYQNNYTYNGFLNNFLDAIDGSYCSEASPLDPPYPNPADGGYKSPRQCGVYKPTNVISISYGGAEADLPIAYQRRQCQEFMKLGLQGVSIVVASGDSGVQGRGGSPTPSGCLGKDNKVFAPDFPATCPYLTTAGGTYLPPGADVHAHEEQATTSFPSGGGFSNIYQRPDYQNAAVEEYFNTAQLSYPYYESVDNSSFAANGGIYNRIGRAYPDVAAIADNVLVFNKGLPTLVGGTSAAAPVFAALLTRINEERLAAGKKTVGFVNPVLYANPGVFFDVTKGSNQGCGTDGFPAVKGWDPVTGLGTPNYPKLLELFMGLD

SEQ ID NO: 558 - protein, 642 aa, Penicillium chrysogenum
MLCVLAASAMAVPTAHDYQLHERRDFIPKSWVEGKELDGNVSLPVRIGLTQSNLDYGHELLMDLSNPHSSRYGQYLSVNEVHDLFAPTEKSVNDVRYWLESAGIAKERITQSANKQWIQFDADAEELEHLLHTKYYLYSHAETGRSHVACREYGFHLDWIYSLADHRPQISCPELRISLREVTSVRRSTKQKRFMDGVPPILEPILLPIEELLSQSPSLCSQAITPQCIQQMYNISEGHSATEGNELGIFEGIGDVYAQEDLDLFFSKLYSKIPQGTHPILKSVDGGEAPTDTSRAGPESDLDFQISYPIIWPQNSILFQSDDMHYENHYTFRGFLNTFLDAIDGSYCSTISPLDPPYPDPADGGYKGSLQCGVYDPPKVISISYGSAEADLPISYQRRQCAEFMKLGTMGVSVLVASGDSGVSGRGGDPTPSNCLGTNGRVFAPDFPATCPYLTAVGGTEIPTGSSPEDHQEQAVTRFPSGGGFSNIYKAPEYQAQAVADYFDKAQPSYPYYESVDNSSFGENSGIYNRIGRAYPDVAAVGDKVVIYNRGMAVSIGGTSASAPVFAAILTRINEERLAAGKSTVGFVNPVLYAHPEAFFDVVTGSNPGCNTDGFSAAKGWDPVTGLGTPNYPELLRVFMGE

SEQ ID NO: 559 - protein, 611 aa, Aspergillus nidulans
MWLSLLYLVSSITAVLAFSPPAKHPLHERRDALPDYWVEDARLDGQTVLPVRIGMTQSNLDHGHDLLMLISDPSSPEYGKYLSAKEVHDLFAPAEETVERVRAWLESEGISDTRISQSANKQWLRFDATAQELERLLQTEYYLYSHAETRRSHIACREYHVPEALQKHIDYITPGVKFLEIAGPLPILPTERSLTRRDTADASSPIIDGTNLTLSQVTNDALGFCDQIITPACIRGMPCICQPIVHSINGGTAPTTLDNAGPESTLDLAMSYPIIWPQNPIIFQTDDPIWADINNPKFPGIFNNFLDAIDGSYCDPSEEELDPPYPNPAPGGYKGQKQCGVYKPTNVISISYGFAEFELPIRYNRRQCYEWMKLGLQGVSVVAASGNNGVATGGCLGKDRSVFTPGYLICPYITTVGGTYLLPGGDPYNPLEVAVDPSTTPGNWSSGGGFSNIYERPMYQASAVEEYFSRANLNYPYYESINNDSFAANDGIYNRIGRAYPDISAVAVNNFVFWRGGPILGGGTSASAPIFAAILTRINEERLAAGMPTVGFVNPMLYAHPEAFRDITEGNNPGCSTDGFTALEGWDPVTGLGTPIYPKLLEVFMSVKLGL

SEQ ID NO: 560 - protein, 659 aa, Penicillium chrysogenum
MAGYHYSFIVSRDAAPVKHVLHEKRSEHVDWVKGERIKRDSVLPVRIGLAQNNLERGDEYLMAVSDPDSAKYGQYWSAEEVHEFFAPSKDSVDSVRRWLQSSGIHESRIVHSDNKGWLAFDAYAHEVEDLFKAEFYEHEHASTSSMKIGCEEYHVPENIQAHIDYITPGVKLSPIVKKNTKAKRMSHLAHSKGTVEADNSIKTTVISEKAQSLPADLQRCGTDMTPACIMALYDIPDATKAAKGNSLGLYEQGDYFAKSDLDLYYKHFAPWIPRGTYPIPALIDGASFSVPDYSPLNAGEADIDIDMAYSLIYPQSITLYQVDDQTYEPEEEKTTNLFNTFLDALDGSYCTYSAFGETGNNPDIDPVYPNPRPGGYKGELQCGVYKPTTVISASYGQAEADLPIAYTKRQCNEFMKLGLQGHSILFSSGDYGVASFHNDGAVNGCLGPEGKIFNPQYPSNCPYVTSVGGTMLYADQTVKDAESVMSANLGGDSANFTSSGGFSNYFPQPSYQKKAVEKYFQKAKLTYPYYSEMEVNINKTKGLYNRIGRGYPDVSANGAVFPAYNGGKLTHYYGASLASPLFASVLNLINEERLDQGKGPVGFVNPVLYAHPEVLNDITNGTNLGCGSDGFSAIPGWDPATGLGTPNYPKLKELFLSLP

SEQ ID NO: 561 - protein, 720 aa, Myceliophthora thermophila
MRIRHALVGIASLCCLLGTASGARISSRDMLSRRVVPPSHTLHERHEAGNVEGWVKRGLADAESTVPVRIGLKQSNVDAAHDLLMDISDPRSPNYGKHLSRSEVEDLFAPREHSVAKVKRWLASAGVDEGRISQSANKQWIQFDAPVYELEKLLLTRYHIFENLETGVQNIACSEYHVPRDVSHHIDYITPGIKLMAGGREERMVRWRKADRRSLVAGLASQGRKGAHGMGHGGGGGSRSPDDPVVDDSPFRVTGPCSAEITPNCIRAQYQLPNGTRAASGNELGIFQGLGQHYSQEDLDNYWKYVAPWVPRGTHPELRSINGALGPANDTLRAGEEADLDFQIAIPLIWPQRTVLFQTDDEWYQQDQQRADTKYPGFFNTFFDAIDGSYCHMTAFNMTGNCVTPECRDPEYPNPNATPEQGGYAGALMCGRHRPTSVVSVSYSGTEDSWPASYMRRQCLEVLKLALQGVTVVESSGDFGVGGRPFDPRAGCLGPDRAVFSPRVMANCPYVLSVGATALVDPEQEQQQQHADRGGSGKEPRLVEVAARTFASGGGFSNIFGRPKWQDRHVREYLRKTNLSELGYDNAAGMSFDSLRPPPAGGKLFNRLGRGYPDVAAVGQNFRVVLRGYPNRMHGTSAAAPVWASILTLINEERRAVGKGPVGFVHQVLYQHPEVFTDITVGSNPGCGTDGFPVEEGWDPVTGLGSPIYPKLLKLFMSLP

SEQ ID NO: 562 - protein, 719 aa, Neurospora crassa
MFRFHLWTLLRLFALLSSLVTASRIVLEEAGHLPAGWKVERHATASDRIQLSIALKEPGIEELKRRLLQQSTSDDHPNSRQFTKEEVEKHRQPDQRSVTAVGRWLQSHGIKSYNADNSWITFKATAATVQMLFEADLAYYSYNGDPSTQILRSRSYTIPRWLSDDIDFVHPLTNFMPPRNRNDGTLGIGRRQPIQPKLSAREDFFAPPCWTGTFPGCIRKLYNLTYTPSPDFRSPSPVRFGIASFLEQYITHRDVTSFLATYARELLPLRPTPSRGGSGGSLTLPPVTNTTSEPPYNITITLLNNATRWDPHSTDPALSGLEANLDVQYALSLGHPTRVIYYATGGRGTKLDSSGRPLPTNDPRANNEPFLEFLQALLALPDNQIPHVLSISYADDEQSVPRKYAHRVCDLFAAVAARGTSVLVATGDGGAAGIGFSAGGGDTCIKNDGSGRRAFVPTFPASCPWVTSVGATDNTALNLTGAAFSSGGFSEYFDRPLWQRAAVDPYVSSLLRSRSSKPGQPSQPRDLKGVYFSHNGRGMPDMAAIGSGFQIIHRGEMVEVRGTSASTPVVAAMVALVNDQRLRQGKRSLGWLNGHLYLDPRVRRVLTDVKWGRSEGCVFPGEALEEGRGKGKEKYWRHSVVEKRQGNSEEDGGTHGGDGEGKADEEDWGGEGEVGEGEGDQSENVILGGWDARKGWDPVTGLGVPGDFQEMLKVLGSVW

SEQ ID NO: 563 - protein, 639 aa, Aspergillus niger
MHVSLFLLSVTAAFASPTPHNYVVHERRDALPSVWVEESRLDKGALLPMRIGLTQSNLDRGHDLLMEVSHPQSSRYGKHLSSEEVHDLFAPSNEAVETVRTWIESAGIAPSRISQSYNKQWLQFDAHASEVEQLLQTEYYIYTHADTGSSHVTCHEYHVPETIQSHIDYITPGVKMLEVRGTPSKKRDAEKRSLGSLPPILAPLPINITKIFDDPLAHCDLAVTPDCIRAMYNITKGTTATKGNELGIFEDLGDIYSQDDLNLFFANFASDIPQGTHPTLDSIDGATAPTDVTNAGPESDLDFQIAYPIIWPQNTILYQTDDPNYEDNYNFKGLLNNFLYAIDGSYCNETSSLDPQYPDPSPGGYSSPKQCGVYTPTNVISISYGSPEADLPIAYQRRQCHEFMKLGLQGISVVVASGDSGVASSTGTCFGDADNVFVPDFPATCPYLTAVGGTYLPLGADAAKDQEIAVTRFPSGGGFSNIYARPSYQNHSVETYFSTTSDDLTYPYYSGVNYTDFSNTDGVYNRIGRGYPDVSAIADNIIIYNQGEATLVGGTSAAAPAFAAMLTRINEERLAKGKSTVGFVNPVLYEHPEAFRDVTVGSNPGCGTDGFPVAGGWDPVTGLGTPRFEDLMDIFVGDD

SEQ ID NO: 564 - protein, 602 aa, Aspergillus fumigatus; identical to SEQ ID NO: 155

SEQ ID NO: 565 - protein, 611 aa, Aspergillus niger
MLSSLLSQGAAVSLAVLSLLPSPVAAEIFEKLSGVPNGWRYANNPQGNEVIRLQIALQQHDVAGFEQAVMDMSTPGHADYGKHFRTHDEMKRMLLPSETAVDSVRDWLESAGVHNIQVDADWVKFHTTVNKANALLDADFKWYVSDAKHIRRLRTLQYSIPDALVSHINMIQPTTRFGQIQPNRATMRSKPKHADETFLTAATLAQNTSHCDSIITPHCLKQLYNIGDYQADPKSGSKIGFASYLEEYARYADLERFEQHLAPNAIGQNFSVVQFNGGLNDQLSSSDSGEANLDLQYILGVSAPVPITEYSTGGRGELVPDLSSPDPNDNSNEPYLDFLQGILKLNNSDLPQVISTSYGEDEQTIPVPYARTVCNLYAQLGSRGVSVIFSSGDSGVGAACLTNDGTNRTHFPPQFPASCPWVTSVGATSKTSPEQAVSFSSGGFSDLWPRPSYQHAAVQTYLTKHLGNKFSGLFNASGRAFPDVSAQGVNYAVYDKGMLGQFDGTSCSAPTFSGVIALLNDARLRAGLPVMGFLNPFLYGVGSEKGALNDIVNGGSVGCDGRNRFGGTPNGSPVVPFASWNATTGWDPVSGLGTPDFAKLKGVALGEEGGN

SEQ ID NO: 566 - protein, 596 aa, Aspergillus fumigatus
MAPFTFLVGILSLCICCIVLGAAAEPSYAVVEQLRNVPDGWIKHDAAPASELIRFRLAMNQERAAEFERRVIDMSTPGHSSYGQHMKRDDVREFLRPPEEVSDKVLSWLRSENVPAGSIESHGNWVTFTVPVSQAERMLRTRFYAFQHVETSTTQVRTLAYSVPHDVHRYIQMIQPTTRFGQPARHERQPLFHGTVATKEELAANCSTTITPNCLRELYGIYDTRAEPDPRNRLGVSGFLDQYARYDDFENFMRLYATSRTDVNFTVVSINDGLNLQDSSLSSTEASLDVQYAYSLAYKALGTYYTTGGRGPVVPEEGQDTNVSTNEPYLDQLHYLLDLPDEELPAVLSTSYGEDEQSVPESYSNATCNLFAQLGARGVSIIFSSGDSGVGSTCITNDGTKTTRFLPVFPASCPFVTAVGGTHDIQPEKAISFSSGGFSDHFPRPSYQDSSVQGYLEQLGSRWNGLYNPSGRGFPDVAAQATNFVVIDHGQTLRVGGTSASAPVFAAIVSRLNAARLEDGLLKLGFLNPWLYSLNQTGFTDIIDGGSSGCYVGTSNEQLVPNASWNATPGWDPVTGLGTPIYNTLVKLATSVSSTP

SEQ ID NO: 567 - protein, 595 aa, Aspergillus flavus
MPSQQMVLFAYTIGAFSLVLHLLVAALATGPRYSVVERLEKIPDGWVDVGTPSPSKPIELQLAVHPEKITEFEQRVIEISTPGNQNYGRHMSRDEVRNFLYSSDVAPRKVLSWLKAAHIPATSINKHTGWITFTVPVSQAEQLLRTRFYTFEHKKSRATVVRTLKYSVPKELRSFVQMIQPTTRFGQLMPQTEPPLLQALPVTLKDLVAGCSSIVTPSCLRKLYGISDSKPKPDRRNRLGVSGFLDQYARYSDFHQFLRLYAPNITDNNYTVELINGGLNLQDSLEDSSEASLDIQYAAALADTPFTTFYSTAGRGPVIRDLGHNDPSDPHEPYLEQLRYLLDLPDDELPAVLTTSYGELEQSVPEIYARTTCNMFAQLGARGVSVIFSSGDSGVGDSCITNDGTNRTRFQPLYPASCPFVTSVGGTYGKEPEMAIGYSTGGFSEYFPRPSYQDGSVNQYLSQLGSKWEGLYNPNGRAIPDVAAQADHFIIMDHGQLLKTGGTSAAAPVFAGIVSRLNAARLESNKPRLGFLNPWLYSLNQTGFTDIVDGGSVGCFGDVGREVPYASWNATPGWDPVTGLGTPYYKALVEQAMSI

SEQ ID NO: 568 - protein, 1068 aa, Aspergillus nidulans
MVSLSFLAGTLSLVIACFVNVVAADFGYVTVERLQRAPDGWIRGPVAPPFKMIKFHIALRQEKAAELEQVTLDMSTPGHHNYGRHLKRDDVRAFVRPSGETMNRVLAWLESAEIPAESVRTHGNWMEVILPVSRAESLMKTKFHIYTHRDTHRRAIRTLSYSVPRALFPDIQLIQPTTHFGQAVAQGKRPNFQPVAATFDRLTADCSTTITPDCLRELYGLYDTNAKPDVRNRLGISGYLEEYARYSDFHQFMHQFSPNRTEANFSVVSINGGLNLQNSSLPSSEASLDVQYAISLAYNTFATYYTTAGRAPFLPGATGTDEDISINEPYLEQLHYLLDLPDEELPAVLTTSYGEDEQSVPESYAEATCNLFAQLGARGVSVIFSSGDGGVGGSCLANDGTNRTRFQPIFPASCPFVTSVGGTEGMNPERAVEFSGGGFSDRFARPSYQDSSVLGFLKTLGGKWDGLYNPQGRGIPDVAAQANNYIIIDHGKTYHIGGTSASAPVFAAIVSRLNAARLEDGKPRLGFLNPWLYSLNQTGFTDIVDGRSPRPACVSMKTRPGSSAWAKAISADPKTKRGLTHRAPMMYGCHPPWPLCSRPRIVRSTYPCHTAYILHTRVPQFGWEKTIQSSLNGRPPKVPRPGPTSKWATAESPPECQKFPAAEFAEDGIQVTLKTGGAESRDLLHSHVEGVTSCIPNLLVVSDMGQQLGPFYTHDVLADVIHVLSEEDRLVYQRQREDHFYWNKKLQPTKAGWRLDRYKFLAMIEYAYARNPSAKWYVFMEADTTVIWQNLVQLLSRYKWIDPIYIGSPTPGRPIGTWWDPEPTFFVYGGSGIVLSVTAIEHLLREDLEGSAKAESGQTSQLLITKYQDMVREDCCGDSVLGWVAAQRDVKIKGLWPMFNPHPLHGTPLGKSYWCQPVITFHKSDPVQVVELWKWQTERQKKGNDPRPILYSDIVDFFDFEATPVRENWNNADMDSFDASTHEAHDSFDSCKEACHKHDHCFQFTYHRKKCRMARVIRLGNSVSMDGDGDAKAGRSLAGWDVKKIKEFKKAHNCEKVDWPEPSTERIF

SEQ ID NO: 569 - protein, 593 aa, Penicillium chrysogenum
MRLQFLLLRALGLFLCYTQLVFAVDASYELVEQLDKAPDGWSRGDKPPASKFIKFRLAIAQHNAREFEQKVIELSTPEHPSYGQHMSRDEVKQFLTPHPAISDRIIAWLRSENVPANSINLYGHWVSFIVPIFQAERMLKTQFFYFHQQGQENPAIRTLGYSVPRALRSHIQLIQPTTLFGNLVPQKSPVFKQKIATPEKLAAGCDVTITPDCLRDLYKIDNTTTRPDWRNRLGISGFLEQYARHDDFNEFLRRYAQSHTDANFSVVSINGGQDGQHSMSDSVEANLDVQYSIPLADEVLATFYSTGGRGPVVPEITHPDPTESSNEPYLEQLHYLLDLPDEELPAVLSNSYGENEQSLPPSYLNATCSLFAQLGARGVSILFGSGDSGPGSSCVKNDGTNQTRFLPGYPASCPFVTAVGGTYGTNPEKAVPFSGGGFSEVFSRPQYQDQAVKGYLGHLGNQWNGLYNATGRGYPDISAQAANFIVRDQGDWISVGGTSASTPVLAGVISRLNAARIAQGKPRMGFLNPWLYSHGQTGFTDIVLGSSSGCKWTSDARVRNASWDATEGWDPATGLGTPLFPALVKLVLSDGQA

SEQ ID NO: 570 - protein, 568 aa, Aspergillus fumigatus
MLSSTLYAGWLLSLAAPALCVVQEKLSAVPSGWTLIEDASESDTITLSIALARQNLDQLESKLTTLATPGNPEYGKWLDQSDIESLFPTASDDAVLQWLKAAGITQVSRQGSLVNFATTVGTANKLFDTKFSYYRNGASQKLRTTQYSIPDHLTESIDLIAPTVFFGKEQNSALSSHAVKLPALPRRAATNSSCANLITPDCLVEMYNLGDYKPDASSGSRVGFGSFLNESANYADLAAYEQLFNIPPQNFSVELINRGVNDQNWATASLGEANLDVELIVAVSHPLPVVEFITGALPPVLRVLALQTQLPSSSGDFQLTVPEYYARRVCNLIGLMGLRGITVLESSGDTGIGSACMSNDGTNKPQFTPTFPGTCPFITAVGGTQSYAPEVAWDGSSGGFSNYFSRPWYQSFAVDNYLNNHITKDTKKYYSQYTNFKGRGFPDVSAHSLTPYYEVVLTGKHYKSGGTSAASPVFAGIVGLLNDARLRAGKSTLGFLNPLLYSILAEGFTDITAGSSIGCNGINPQTGKPVPGGGIIPYAHWNATAGWDPVTGLGVPDFMKLKELVLSL

SEQ ID NO: 571 - protein, 580 aa, Aspergillus fumigatus
MYPLDGSARPHPPGTTRLNSVEPDKQIGFTVLVRPQTGAPRLPDLAQWQAIPIAERQFLSTAGFERTYGSSEDDIVSVASFLEKAGMTIRSRHAGAGTVEVQAKTCQIHSVFAVQLLYYRGQLRPAARKRRDDKQPAEETYIGFEGCISLPAALHDKVIHIFGLDTRTFGASGGYSGDPPRAQRLIVAELAALYGFPAGVDASQQTIGIFSGEGNDDKGQSLSNYRPADVAAYFNNQTVGYNRAPTVVPVSLTVADQTYRNDPDHPTQELSQDIMTAATIAQGCTVNVYFSDLTEQGWLAFLTRVLFPQGEEKRPTIVSISWTMYDEQTYRDRLSFLFQRLAVVGTSVFAIAGDWGANNNIIDGQPHVGWPGSDPWVTCVGGTVVGNVRSSGAFTEHAWSDRDNPDSQFTIDGHLGVTGGGMSRVFATPPYQLSSGISAVTDCNGERWTGGRFIPDITGMVGFRGFIVNGKRNYFIGTSCSTPLYAGLFAALASALGGGGEGGVLFGPLNTVLYQIDRGVYRDITFGHNDSGDMPACAYFAAGEGYDTVSGLGSVDGRRTLEELRRIYWPKTKGFGCFRN

SEQ ID NO: 572 - protein, 454 aa, Neurospora crassa
MRATLVVVLCHLSLAFALAISPAASHWKRSARLASDQTASERYSLPSRVARYIDYVLPAPDPDPVSSAPKSVAVQDPPTLKGVIGARQTRDVDCLQYIAPQCLRQLAWLAEDLDMFFGDFAPDLLTNFNLEPNLDYKYTMAMAKPIPVTNIQVGDFVVQGNMNIMLAAFNAHYCRTGLDPQFDPVYPNPAPGGYNASDCGTHVPPRVIAIMYAWNKAWYSDADFASIFPASDPWVTSVGGTQFLPVVSNGSSSTTASSGMPSSSSSSSSSSSSSSSSSSSSLFPGETALDDNNTGSSGGSFSRLFPGPWYQGNLTREYLASAPGAAELARQGYFNGSGRGYPDISAMARSFLVALHGGYHAVSGTSASTPVVAAMVAKINDARLHAGKSTVGFLNPVLYSAAAGKAGVLRDVPLGKNHDCGVGEAFPARRAWDAVTGLGTPDFEKLKELYLGLP

SEQ ID NO: 573 - protein, 652 aa, Aspergillus oryzae
MRPLSHLSFFNGLLLGLSALSAATSVVHERREATSSNWVKRARVNPSDKHVVRIGLTQSSLEEAHDLLMDVSNPSSPNYARFYSADEVAAKFAPSTETVNEVQNWLTEKGINASRVARTQNHGWLVFHATSKEIENLFDTTYYEYHNRKTGKKAIACEQYHVPASVQKHIDYVHPGVNLNPSSGKPSSIRRRAAASKKTKLPARGPRPIQQHDVKGLNVTNCDQLITPECIRALYKIPSARAAPHPNNSLGIFEEGDYYAQEDLDLFFKTFAKDIPQGTHPIPAFIDGAEAPVPVTKAGGESDLDFELAYPIVHPQSITLYQTDDANWASNTTGFLNTFLDALDGSYCTYCAYGECGNDPSLDPVYPDDAGYDGQLMCGVFKPTNVISVSYGEQENDLPANYQQRQCMEFLKLGLQGVSVLFASGDNGVAGPPGDGNSVNGCLNNGTVFSPAFPNSCPYITNVGATKVYPGYTVSQPESAVYDPDGLYSYASGGGFSNIYPIPDYQAEAVATYFKDHNPPYPYYEGAENLGKNGGLYNRLGRGYPDVAANGDNIAVFNGGEFGSSGGTSASTPIFASIINRIIDERLAVGKGPVGFINPVLYKNPSVLNDITNGTNPGCGTDGFSTAPGWDPATGLGTPNYPKMLKLWLDLP

SEQ ID NO: 574 - protein, 243 aa, Myceliophthora thermophila
MKLAVLIATTAGLAAALPQGVARRGVGRPLHHSGPNIRNTTYPQYSSNWAGAVQIGTGFTSVYGTITVPSVHDRNPNAAASAWVGIDGDTCQQAILQTGVSFYGDGSFDAWYEWIPDYAYSFSNFRLSAGDQIRMSVEASSKRAGVATLENLSTGQKVSHTFTSTPSTLCETNAEWIVEDFQEGSSLVPFADFGTVTFTDAYATGSSGTVTPSGATIIDIKQGNEVLTNCATSGSDLTCSYTG

SEQ ID NO: 575 - protein, 256 aa, Aspergillus oryzae
MKLFAILSSTVLASVALASPLTLERRARNAARLQARVAQRHSNLPFKAGTNEILHLNETTHEEYSSNWAGAVLIGSGLHVRDRDEQYCATAWVGIDGDTCQSAILQTGVDFCIDSSGTTSDAWYEWFPDYSHDFSGISISAGDKVKVTVDASSKTAGTAIVENLTTGKTVSHTFAGQDDNALCETNAEWIMEDFSSFLSLVPFANFGTVTFTDISATSGDSSVGASNATIIDIQQNNKTLTSSSASDTEVTIKYIG

SEQ ID NO: 576 - protein, 288 aa, Neurospora crassa
MKLLSPAISLLGVISQPILAQFTFTSTVEHNGVPVPQAETDLKPFKPGTLGRIRSRTDDDSGPEIGTTTLRRVKRTNPTANSNNWCGSVQSTTSSNQIKLVHGTFQHPTCTQRPGVTQYPQAAAAWIGIDGDSWTSALLQAGTVCKINNSTGIVENEVWWQWVPNGAYTITNIPVFAGDWFDITINTTSSTAATIKIMSNRGYTYSVNAWQGATLARVDADWVVERPYYGSTLAGFAQFTQVWFQNAYATLTSGTSSLGITGAKQYQIPGGCASAEYDNSKLYAAVAA

SEQ ID NO: 577 - protein, 282 aa, Aspergillus niger; identical to SEQ ID NO: 144

SEQ ID NO: 578 - protein, 269 aa, Penicillium chrysogenum
MKFAVAIFSTTLLATSVIASPLASQREAHSEIQRSVQGPRRTTRPRNPGTSEVLYLNQTSQETYSSKWAGAVLIGTGYTSVSGEITVPIPHLPNGANSYTNYCASAWVGIDGDTCSTAILQAGIDFCIQGGFISYNAWYEWYPDYAHNFSNIQILPGDVIKMTVDATSKSSGFVTIENLSTGVSVMHIFPYSLRGDLCEFNAEWIVEDFSVNNALAPFADFGTVVFSNAVASRGGDTYGPLGATIMDIYQDRILTSSSVTRDTVTISYI

SEQ ID NO: 579 - protein, 310 aa, Aspergillus niger
MGGRDVAILSRHFAVTSSQSVNGVVSGMFQHTVTSSPSFTTNQFFKKKFTAAIATAIFASVAVAAPQRGLEARLKARGSSKGSRPLQAVARPASTKNQTNVEYSSNWSGAVLVEPPSAAATYTAVTGTFTVPEPTGNSGGSQAASAWVGIDGDTYGNAILQTGVDFTVTDGEASFDAWYEWYPDYAYDFSGIDISAGDEIVAIVESYTSTTGIAIIENKSTGQKVSKELSSSSSLGGQNAEWIVEDFEENGSLVNLVDFGTVTFTGAVAKAAGGESVGLTDATIIEIEENGQVVTDVTIDSDSEVTITYE

SEQ ID NO: 580 - protein, 264 aa, Aspergillus oryzae
MKFTTAIATAILAGSALAAPERGLAARVKARAAGARGSRPLQTVQKPAGVTNKTNVEYSSNWSGAVLENPPSASATYTAVTGTFTVPEPTGGSGSSSASAWVGIDGDTYSEAILQTGVDFTVTNGQASFDAWYEWLPDYAYDFTGIDISAGDVIVAIVESYSSTSGIAIIENQSTGQKVTKELSSSSPLGGINAEWIVEDYEENGSLVDLVDFGTVTFTGAEAKAAGGQTVGLTDATIIEITQNNKVVTDVTIDSDSEVTITYV

SEQ ID NO: 581 - protein, 279 aa, Aspergillus niger
MKFTNYLLTTATLASSVLAAPAPRTGLEDRLRARSLQRQSHPLAPIPLDTSTKENSRLLEADENTTHVTYSSNWAGAVREQPPPQGTYSAVSATFRVPEPTAQGGSGTQAGSAWVGIDGDTYSNAILQTGVDFYVENGQTYNDAWYEWYPDYAYDFDLDVSTGDTIVAKVEAISPSQGVATIENISTGKKATQTIRAPAATATLAGQNADWIVEDFQSGDSMVDLAGFGEISFWGVQAQGGGSTWGVDDATIVELKQGNEVLTDVEVQSDSAFTVKYTS

SEQ ID NO: 582 - protein, 279 aa, Aspergillus nidulans
MKLSLTSSLLTTTTLLGSALSLPQTSNLVSRIQARSLNRQSHPLTRQDGGHSGSQTGFRMASTAAVAYSNNWAGVVREEAPPGGPYTAVSATFTVPKPTAAPNTAGLQAGSAWVGIDGDTYSGAILQTGVDFYIDNGRVYNDAWFEWFPDYAYDFNLAINTGDVIVAKVEALSPSNGVAIIENKNTGQTATQTISAPKADATLKGVNADWIVEDFQSGDKVVALADFEQVTFTGCEAKAQNGDSLGLDGSTIIELKQNNKVLTEVTVKGNNELTVASKM

SEQ ID NO: 583 - protein, 271 aa, Aspergillus oryzae
MKPTHAYLTAALISGALAAPGSTLAQRMRHRSLDHLTLPLQGEGSATDSEARVAGAAVQYSNNWAGVVREQAPPEGPYTAVSATFTVPSATAVANQNGVQAGSVWVGIDGDTYAGAILQAGVDFYSDPTQQNHAWFEWYPAYATNFPNIEVNAGDTIVSTVRSNSPSEGIAIIENKSTGQTVSQTVTAPEPTATLAGQNAEWIVEDFQSGDTMVVLANFGEVEFSGAQAEAGNAKFGLKGGEVIELKQNNKVLTQTEVTGDQDMTVKFIGA

SEQ ID NO: 584 - protein, 270 aa, Penicillium chrysogenum
MKFTSTTILATAILAGTSFAAPRSGLIDRLQSRGTLPRQSLPDEEKGVLLKEAAAGANAQYSKNWAGVVREQPPPSGTYSAVSATFTVPEPTATNDSGEMQAVSAWVGIDGDTYTKAILQTGIDTYIQDGKKTFDAWYEWYPLSAENFDLALSAGDVIVAKVETYSPSKGAAIIENKSSGQSVTKTLSAPSADATLAGQNAEWIVEDFNTGNSMVPLVNFNRVDFTGAQAEAGGAKYGVNNAAVLDIQQNGDVKAHVEIQSDTEFFVTYQ

SEQ ID NO: 585 - protein, 285 aa, Myceliophthora thermophila
MWSIVRSLSLASLISSACTVTAQLSFVASVKQHGKDVDASGLSFVRIPPLEHRWHASRPRRGQNNRTVERDAVSYSANWCGASQHASDSDGIKSVLGYFTAPDLTLRPGTPAPQFAAAWVGIDGAACNTTLLQAGVTTIVNSDGGQSASAWWEWYPEASYTISGLKVKAGEWMSVNITTKDASSAILVIENADTGTSVTLELNNGPQLCRRDAEWILEDFYESGKQVALANFADLWFVDSGATTVGGKNVGFDGATMVHLRDENGNVLCSPEPYDNSNFVVVSKP

SEQ ID NO: 586 - protein, 293 aa, Aspergillus oryzae
MKFPSSLALTALLTGTALAGPHGQGLRARRFQGPGWLGEIDLDSPSEAQAEQPNAQVTPAPQAKSKAIAHSQAQSEDDYLINENWAGAVQTTAPAASATYSYVAATFTLPSVTPTAASSSQTQAASFWVGIDGATSGDAIWQAGVDIYVQNGKPSFAGWYEWYPANSVNIDLEFNFGDVVFTSVESTSNSEGVAVIENLTTGKNVTVTASAPATATLTGQNAEWILEDLAVDGDGLTFVDFGEATFTGCVAKAGGKEYGLGGSALYAVQDRSSNTVQAVPTIVSDSELKVTYQ

SEQ ID NO: 587 - protein, 307 aa, Myceliophthora thermophila
MKPTVLFTLLASGAYAAATPAIPGYSPRTRGMNPHHHAPLRLLHTFTPISTSGKSFRLLASSTESTKGGAILGLPDNDLSTVRTTIRIPAAKMPTAGPTANNTVGEYAASFWVGIDSATDACGAGGSLRAGVDIFWDGTLGGQQTPFAWYQGPGQADVVGFGGGFPVGEGDLVRLTLEAGPAGGEEIAVVAENFGRNVTRADEGAVPVRKVRKVLPAEAGGQKLCRGEAAWMVEDFPLQGRPEFPTALANFTSVTFNTGITLDDGTEKDLTGAEVLDIQLEAQGGRLTSCEVVDDRNVKCARVVGDN

SEQ ID NO: 588 - protein, 197 aa, Myceliophthora thermophila
MRWPLAALLGSALVARQALAELTFTVEATRNGVPIPASEIRLEPFEPGRTRMGAVAEAPRAQRKTRRSNAQADSANWCGSVNMAPTGTNIQLAHGSFQHPSCSIRPGYTFPQAAASWVGIDGDSYRDALLQAGTVCKIDNSTGVVRHEAWWQWVPSAAFTITSMPGQSNTTGFCIPYSAPFVSLCFFGRTRTCLFLH

SEQ ID NO: 589 - protein, 58 aa, Homo sapiens
MRFRIYKRKVLILTLVVAACGFVLWSSNGRQRKNEALAPPLLDAEPARGAGGRGGDHP

SEQ ID NO: 590 - protein, 51 aa, Trichoderma atraviride
MASTNARYVRYLLIAFFTILVFYFVSNSKYEGVDLNKGTFTAPDSTKTTPK

SEQ ID NO: 591 - protein, 52 aa, Trichoderma reesei
MAIARPVRALGGLAAILWCFFLYQLLRPSSSYNSPGDRYINFERDPNLDPTG

SEQ ID NO: 592 - protein, 33 aa, Trichoderma reesei
MLNPRRALIAAAFILTVFFLISRSHNSESASTS

SEQ ID NO: 593 - protein, 84 aa, Trichoderma reesei
MMPRHHSSGFSNGYPRADTFEISPHRFQPRATLPPHRKRKRTAIRVGIAVVVILVLVLWFGQPRSVASLISLGILSGYDDLKLE

SEQ ID NO: 594 - protein, 55 aa, Trichoderma reesei
MLLPKGGLDWRSARAQIPPTRALWNAVTRTRFILLVGITGLILLLWRGVSTSASE

SEQ ID NO: 595 - DNA, 68 bp, Artificial Sequence
  Primer
gattaagttgggtaacgccagggttttcccagtcacgacggtttaaacatcgtgcttgggctattctg

SEQ ID NO: 596 - DNA, 68 bp, Artificial Sequence
  Primer
gcgctggcaacgagagcagagcagcagtagtcgatgctaggcggccgcggaaagacgccagaaagaaa

SEQ ID NO: 597 - DNA, 68 bp, Artificial Sequence
  primer
gtacacttgtttagaggtaatccttctttctagaaggagagcggccgccgctcgatgtggatgatact

SEQ ID NO: 598 - DNA, 68 bp, Artificial Sequence
  Primer
atctatactgtctgcaccaaaagtacaacaacgcaaaccgggcgcgccggaaagacgccagaaagaaa

SEQ ID NO: 599 - DNA, 20 bp, Artificial Sequence
  Primer
cggtttgcgttgttgtactt

SEQ ID NO: 600 - DNA, 68 bp, Artificial Sequence
  Primer
tggaattgtgagcggataacaatttcacacaggaaacagcgtttaaacacaacccaacgttctctcgt

SEQ ID NO: 601 - DNA, 69 bp, Artificial Sequence
  Primer
gattaagttgggtaacgccagggttttcccagtcacgacggtttaaaccggttgtccatttcatccttc

SEQ ID NO: 602 - DNA, 68 bp, Artificial Sequence
  Primer
gcgctggcaacgagagcagagcagcagtagtcgatgctaggcggccgcggggaagcaagtttcgaagt

SEQ ID NO: 603 - DNA, 66 bp, Artificial Sequence
  Primer
gtacacttgtttagaggtaatccttctttctagaaggagagcggccgcctccacgctcttggccac

SEQ ID NO: 604 - DNA, 68 bp, Artificial Sequence
  Primer
gtcattaagtccatcattccacgtccttcagaccgaattcggcgcgccggggaagcaagtttcgaagt

SEQ ID NO: 605 - DNA, 68 bp, Artificial Sequence
  Primer
atgatgcctttgcagaaatggcttgctcgctgactgatacggcgcgcctatcgcgaaagtagccaata

SEQ ID NO: 606 - DNA, 58 bp, Artificial Sequence
  Primer
agcggataacaatttcacacaggaaacagcgtttaaaccatccttttcctcaccacga

SEQ ID NO: 607 - DNA, 68 bp, Artificial Sequence
  Primer
tgattgtaccccagctgcgattgatgtgtatctttgcatgatttaaattctccttagctctgtacagt

SEQ ID NO: 608 - DNA, 28 bp, Artificial Sequence
  Primer
gcggccgctctccttctagaaagaagga

SEQ ID NO: 609 - DNA, 20 bp, Artificial Sequence
  Primer
gaattcggtctgaaggacgt

SEQ ID NO: 610 - DNA, 60 bp, Artificial Sequence
  Primer
tgatggtgatgaggcggaaaagcagaggttacggcgctgaggctttcgtgaccgggcttc

SEQ ID NO: 611 - DNA, 20 bp, Artificial Sequence
  Primer
gtatcagtcagcgagcaagc

SEQ ID NO: 612 - DNA, 18 bp, Artificial Sequence
  Primer
ggaatcgtcaccaaggag

SEQ ID NO: 613 - DNA, 19 bp, Artificial Sequence
  Primer
cttctggtgacattccgac

SEQ ID NO: 614 - DNA, 20 bp, Artificial Sequence
  Primer
cctctgcgttgagcaacata

SEQ ID NO: 615 - DNA, 20 bp, Artificial Sequence
  Primer
cgaaagcgtggagtcttctc

SEQ ID NO: 616 - DNA, 19 bp, Artificial Sequence
  Primer
aacaaagccttcacaggcc

SEQ ID NO: 617 - DNA, 20 bp, Artificial Sequence
  Primer
tgaggctccttccaactttt

SEQ ID NO: 618 - DNA, 59 bp, Artificial Sequence
  Primer
ggtaacgccagggttttcccagtcacgacggtttaaaccgacagcacgttgtgtgctcc

SEQ ID NO: 619 - DNA, 68 bp, Artificial Sequence
  Primer
gcgctggcaacgagagcagagcagcagtagtcgatgctaggcggccgctggagacccagcagccagca

SEQ ID NO: 620 - DNA, 68 bp, Artificial Sequence
  Primer
cccgtcaccgagatctgatccgtcaccgggatccacttaagcggccgctcagagggaggctgcccaac

SEQ ID NO: 621 - DNA, 68 bp, Artificial Sequence
  Primer
gagactcgaacaaagacatctttgcgacctcgtccacggcggcgcgcctggagacccagcagccagca

SEQ ID NO: 622 - DNA, 20 bp, Artificial Sequence
  Primer
gccgtggacgaggtcgcaaa

SEQ ID NO: 623 - DNA, 58 bp, Artificial Sequence
  Primer
agcggataacaatttcacacaggaaacagcgtttaaacccctgcgccctcttctgcac

SEQ ID NO: 624 - DNA, 18 bp, Artificial Sequence
  Primer
ggaatcgtcaccaaggag

SEQ ID NO: 625 - DNA, 19 bp, Artificial Sequence
  Primer
cttctggtgacattccgac

SEQ ID NO: 626 - DNA, 20 bp, Artificial Sequence
  Primer
agcagtccacctgctcaaaa

SEQ ID NO: 627 - DNA, 20 bp, Artificial Sequence
  Primer
gattcacaccaatgagtcgg

SEQ ID NO: 628 - DNA, 20 bp, Artificial Sequence
  Primer
ccccgactttgccccgtcac

SEQ ID NO: 629 - DNA, 20 bp, Artificial Sequence
  Primer
tcgtcagagtcgtcgcccgt

SEQ ID NO: 630 - DNA, 20 bp, Artificial Sequence
  Primer
gcgcagctaatgtcctctgt

SEQ ID NO: 631 - DNA, 20 bp, Artificial Sequence
  Primer
ttgttgagccagagtcgaga

SEQ ID NO: 632 - DNA, 57 bp, Artificial Sequence
  Primer
gtaacgccagggttttcccagtcacgacggtttaaacatgagcgtgatcgacaagtg

SEQ ID NO: 633 - DNA, 68 bp, Artificial Sequence
  Primer
gcgctggcaacgagagcagagcagcagtagtcgatgctaggcggccgccctctgaggtcgagatggag

SEQ ID NO: 634 - DNA, 68 bp, Artificial Sequence
  Primer
tgattgtaccccagctgcgattgatgtgtatctttgcatggcggccgcacgactaatatccactgccg

SEQ ID NO: 635 - DNA, 68 bp, Artificial Sequence
  Primer
aaccaaagtgtacaatgctcatctcgtattcacatgcaaaggcgcgcccctctgaggtcgagatggag

SEQ ID NO: 636 - DNA, 22 bp, Artificial Sequence
  Primer
tttgcatgtgaatacgagatga

SEQ ID NO: 637 - DNA, 57 bp, Artificial Sequence
  Primer
gcggataacaatttcacacaggaaacagcgtttaaactgctcgatcctactccaagg

SEQ ID NO: 638 - DNA, 18 bp, Artificial Sequence
  Primer
ctgtaaaggcagcatcgg

SEQ ID NO: 639 - DNA, 20 bp, Artificial Sequence
  Primer
tcagaacggcttcaatcatt

SEQ ID NO: 640 - DNA, 18 bp, Artificial Sequence
  Primer
ctgtaaaggcagcatcgg

SEQ ID NO: 641 - DNA, 20 bp, Artificial Sequence
  Primer
ttacgactcgatccctgtcc

SEQ ID NO: 642 - DNA, 20 bp, Artificial Sequence
  Primer
gccgctaggatcgtgataag

SEQ ID NO: 643 - DNA, 20 bp, Artificial Sequence
  Primer
gtgtcccaggacgacaactt

SEQ ID NO: 644 - DNA, 20 bp, Artificial Sequence
  Primer
tgaaggttgcagtgatctcg

SEQ ID NO: 645 - DNA, 57 bp, Artificial Sequence
  Primer
gtaacgccagggttttcccagtcacgacggtttaaaccgcattacgaatgcacaaag

SEQ ID NO: 646 - DNA, 68 bp, Artificial Sequence
  Primer
gcgctggcaacgagagcagagcagcagtagtcgatgctaggcggccgcccatgtcagctcagaccaat

SEQ ID NO: 647 - DNA, 68 bp, Artificial Sequence
  Primer
gtacacttgtttagaggtaatccttctttctagaaggagagcggccgcaggccctggactgctagttt

SEQ ID NO: 648 - DNA, 68 bp, Artificial Sequence
  Primer
cgagccatccgccgcggccctatattccacccgagtcctcggcgcgccccatgtcagctcagaccaat

SEQ ID NO: 649 - DNA, 22 bp, Artificial Sequence
  Primer
gaggactcgggtggaatatagg

SEQ ID NO: 650 - DNA, 59 bp, Artificial Sequence
  Primer
gcggataacaatttcacacaggaaacagcgtttaaacttggtcttgaatgaaaggtgtg

SEQ ID NO: 651 - DNA, 57 bp, Artificial Sequence
  Primer
gtaacgccagggttttcccagtcacgacggtttaaacaggtttgggttgtgagatcg

SEQ ID NO: 652 - DNA, 68 bp, Artificial Sequence
  Primer
gcgctggcaacgagagcagagcagcagtagtcgatgctaggcggccgcgcgcaaagctactgggctat

SEQ ID NO: 653 - DNA, 68 bp, Artificial Sequence
  Primer
tgattgtaccccagctgcgattgatgtgtatctttgcatggcggccgctctgctctgctctgttctgc

SEQ ID NO: 654 - DNA, 68 bp, Artificial Sequence
  Primer
aaagttcgtcaaagagcactcatagggctgagaaaagccaggcgcgccgcgcaaagctactgggctat

SEQ ID NO: 655 - DNA, 20 bp, Artificial Sequence
  Primer
tggcttttctcagccctatg

SEQ ID NO: 656 - DNA, 57 bp, Artificial Sequence
  Primer
gcggataacaatttcacacaggaaacagcgtttaaaccaatgtgtgcctgtttttcg

SEQ ID NO: 657 - DNA, 57 bp, Artificial Sequence; identical to SEQ ID NO: 651
  Primer

SEQ ID NO: 658 - DNA, 68 bp, Artificial Sequence; identical to SEQ ID NO: 652
  Primer

SEQ ID NO: 659 - DNA, 68 bp, Artificial Sequence
  Primer
caaccagccgcagcctcagcctctctcagcctcatcagccgcggccgctggcttttctcagccctatg

SEQ ID NO: 660 - DNA, 57 bp, Artificial Sequence; identical to SEQ ID NO: 656
  Primer

SEQ ID NO: 661 - DNA, 20 bp, Artificial Sequence
  Primer
tttatccgcttccacgacac

SEQ ID NO: 662 - DNA, 20 bp, Artificial Sequence
  Primer
tcttgagcacgacaatcgac

SEQ ID NO: 663 - DNA, 20 bp, Artificial Sequence
  Primer
gcatggttgcctagtgaatg

SEQ ID NO: 664 - DNA, 20 bp, Artificial Sequence
  Primer
cgatggtgaagtcaatgtgg

SEQ ID NO: 665 - DNA, 20 bp, Artificial Sequence
  Primer
ggcgattacttccaggacaa

SEQ ID NO: 666 - DNA, 20 bp, Artificial Sequence
  Primer
caatggcaatctggttgttg

SEQ ID NO: 667 - DNA, 57 bp, Artificial Sequence; identical to SEQ ID NO: 632
  Primer

SEQ ID NO: 668 - DNA, 68 bp, Artificial Sequence; identical to SEQ ID NO: 633
  Primer

SEQ ID NO: 669 - DNA, 70 bp, Artificial Sequence
  Primer
caaccagccgcagcctcagcctctctcagcctcatcagccgcggccgctttgcatgtgaatacgagatga

SEQ ID NO: 670 - DNA, 57 bp, Artificial Sequence; identical to SEQ ID NO: 637
  Primer

SEQ ID NO: 671 - DNA, 20 bp, Artificial Sequence
  Primer
ttacgactcgatccctgtcc

SEQ ID NO: 672 - DNA, 20 bp, Artificial Sequence
  Primer
tcttgagcacgacaatcgac

SEQ ID NO: 673 - DNA, 20 bp, Artificial Sequence
  Primer
gcatggttgcctagtgaatg

SEQ ID NO: 674 - DNA, 20 bp, Artificial Sequence
  Primer
gccgctaggatcgtgataag

SEQ ID NO: 675 - DNA, 20 bp, Artificial Sequence
  Primer
gtgtcccaggacgacaactt

SEQ ID NO: 676 - DNA, 20 bp, Artificial Sequence
  Primer
tgaaggttgcagtgatctcg

SEQ ID NO: 677 - DNA, 20 bp, Artificial Sequence
  Primer
ttggtttgaacagctgcaag

SEQ ID NO: 678 - DNA, 20 bp, Artificial Sequence
  Primer
tcttgagcacgacaatcgac

SEQ ID NO: 679 - DNA, 20 bp, Artificial Sequence
  Primer
gcatggttgcctagtgaatg

SEQ ID NO: 680 - DNA, 20 bp, Artificial Sequence
  Primer
atggtcagccagaacctgac

SEQ ID NO: 681 - DNA, 20 bp, Artificial Sequence
  Primer
tcttgagccgtttctcgaat

SEQ ID NO: 682 - DNA, 20 bp, Artificial Sequence
  Primer
ccgctcttagatcgatggtc

SEQ ID NO: 683 - DNA, 60 bp, Artificial Sequence
  Primer
tctccactcgacctgcaggcatgcgcgatcgcgcggccgaattcggtctgaaggacgtgg

SEQ ID NO: 684 - DNA, 61 bp, Artificial Sequence
  Primer
tggcgccccacagcacaagccctgcagactgcttcttcagcatgttgagagaagttgttgg

SEQ ID NO: 685 - DNA, 62 bp, Artificial Sequence
  Primer
catctccactcgacctgcaggcatgcgcgatcgcgcggccgaattcggtctgaaggacgtgg

SEQ ID NO: 686 - DNA, 60 bp, Artificial Sequence
  Primer
ggggatgccctgtcgagccagcgggggagggtgcccaccgccgcccctcccgcccagccg

SEQ ID NO: 687 - DNA, 73 bp, Artificial Sequence
  Primer
gaaggtggtttttgcctgtataagccagccatccggcatactgcccgcggccgccctgcagtgcaggatctgc

SEQ ID NO: 688 - DNA, 64 bp, Artificial Sequence
  Primer
tggcgcccccaccgacgtgggagggctatgatcccagctggaattagcatatgattaattaagg

SEQ ID NO: 689 - DNA, 62 bp, Artificial Sequence
  Primer
ggtttttgcctgtataagccagccatccggcatactgcccgcggccgcagtgcaggatctgc

SEQ ID NO: 690 - DNA, 20 bp, Artificial Sequence
  Primer
gatgttgcgcctgggttgac

SEQ ID NO: 691 - DNA, 19 bp, Artificial Sequence
  Primer
cttcttattgatttgagcc

SEQ ID NO: 692 - DNA, 20 bp, Artificial Sequence
  Primer
gattgtcatggtgtacgtga

SEQ ID NO: 693 - DNA, 16 bp, Artificial Sequence
  Primer
gagccgcatcgcatag

SEQ ID NO: 694 - DNA, 20 bp, Artificial Sequence
  Primer
gcgtcactcatcaaaactgc

SEQ ID NO: 695 - DNA, 19 bp, Artificial Sequence
  Primer
cttcggcttcgatgtttca

SEQ ID NO: 696 - DNA, 26 bp, Artificial Sequence
  Primer
atggcgtcaacaaatgcgcgctatgt

SEQ ID NO: 697 - DNA, 75 bp, Artificial Sequence
  Primer
attcacactctcagaataaattcatcgccaatttgacaggccggccattctcacggtgaatgtaggccttttgta

SEQ ID NO: 698 - DNA, 75 bp, Artificial Sequence
  Primer
ttagtagatagcgcacatagcgcgcatttgttgacgccatgcggttgactattgggtttctgtgcctcaaaagat

SEQ ID NO: 699 - DNA, 71 bp, Artificial Sequence
  Primer
cacactctcagaataaattcatcgccaatttgacaggccggccgcccttgtatctctacacacaggctcaa

SEQ ID NO: 700 - DNA, 25 bp, Artificial Sequence
  Primer
ctgcagtgcaggatctgcatatatg

SEQ ID NO: 701 - DNA, 70 bp, Artificial Sequence
  Primer
ttattcacactctcagaataaattcatcgccaatttgacaggccggccactagtggtctgaaggacgtgg

SEQ ID NO: 702 - DNA, 63 bp, Artificial Sequence
  Primer
ttagtagatagcgcacatagcgcgcatttgttgacgccatctgatgtctgctcaagcggggta

SEQ ID NO: 703 - DNA, 71 bp, Artificial Sequence
  Primer
aggaccttaattaatcatatatgcagatcctgcactgcaggcggccgccactctgagctgaatgcagaagc

SEQ ID NO: 704 - DNA, 71 bp, Artificial Sequence
  Primer
cttgacctcggagaaagttaccctccttttgtcagacacgatcgatttccaacagatggaaagaagaaagg

SEQ ID NO: 705 - DNA, 61 bp, Artificial Sequence
  Primer
aataccgccgcactggccgtagtgagactgggtaggtcgactaattccagctgggatcata

SEQ ID NO: 706 - DNA, 62 bp, Artificial Sequence
  Primer
cacactctcagaataaattcatcgccaatttgacaggccggccaattctcacggtgaatgta

SEQ ID NO: 707 - DNA, 58 bp, Artificial Sequence
  Primer
ttagtagatagcgcacatagcgcgcatttgttgacgccatgcggttgactattgggtt

SEQ ID NO: 708 - DNA, 24 bp, Artificial Sequence
  Primer
ttcgagggccgggagcgatgccga

SEQ ID NO: 709 - DNA, 59 bp, Artificial Sequence
  Primer
ggcttcaacgacctcgtcggcatcgctcccggccctcgaaacgcgcccagcacctggca

SEQ ID NO: 710 - DNA, 60 bp, Artificial Sequence
  Primer
ataccgccgcactggccgtagtgagactgggtaggtcgactaattccagctaggatcata

SEQ ID NO: 711 - DNA, 69 bp, Artificial Sequence
  Primer
agaataccggattactgatccggagaatactttgtaaatagcggccgcggctgatgaggctgagagagg

SEQ ID NO: 712 - DNA, 58 bp, Artificial Sequence
  Primer
caacgacctcgtcggcatcgctcccggccctcgaatgaacggggatgccctgtcgagc

SEQ ID NO: 713 - DNA, 69 bp, Artificial Sequence
  Primer
gattaagttgggtaacgccagggttttcccagtcacgacggtttaaactccaaagttcctgtcttctcc

SEQ ID NO: 714 - DNA, 23 bp, Artificial Sequence
  Primer
tgtcaaattggcgatgaatttat

SEQ ID NO: 715 - DNA, 69 bp, Artificial Sequence
  Primer
ttattcacactctcagaataaattcatcgccaatttgacaggccggccgggtaggaattgtcactcaag

SEQ ID NO: 716 - DNA, 69 bp, Artificial Sequence
  Primer
gcaacgagagcagagcagcagtagtcgatgctaggcggccgcggccgctcatcgtcttgacagcaatgc

SEQ ID NO: 717 - DNA, 68 bp, Artificial Sequence
  Primer
accagccgcagcctcagcctctctcagcctcatcagccgcgcggccgccactctgagctgaatgcaga

SEQ ID NO: 718 - DNA, 66 bp, Artificial Sequence
  Primer
cctatgttgtgtggaattgtgagcggataacaatttcacagtttaaacgcgctgcctccacgatgt

SEQ ID NO: 719 - DNA, 78 bp, Artificial Sequence
  Primer
gaccaacttgtccgttgcgaggccaacttgcattgctgtcaagacgatgagcggccgcataacggtgagactagcggc

SEQ ID NO: 720 - DNA, 72 bp, Artificial Sequence
  Primer
atacaaacgttggcgaggcttctgcattcagctcagagtggcggccgcgtgctgcggaatcattatcatctg

SEQ ID NO: 721 - DNA, 70 bp, Artificial Sequence
  Primer
gcagcttgactaacagctaccccgcttgagcagacatcatcttaattaatcagtcagcgctctcgatggc

SEQ ID NO: 722 - DNA, 70 bp, Artificial Sequence
  Primer
ccaataccgccgcactggccgtagtgagactgggtaggtcatttaaatctaattccagctgggatcatag

SEQ ID NO: 723 - DNA, 62 bp, Artificial Sequence
  Primer
gcagcttgactaacagctaccccgcttgagcagacatcatcatgcgcttccgaatctacaag

SEQ ID NO: 724 - DNA, 59 bp, Artificial Sequence
  Primer
gggtgaggctggcggggtcgccatcgagagcgctgactgaggggtgatcccctcccctg

SEQ ID NO: 725 - DNA, 99 bp, Artificial Sequence
  Primer
gcagcttgactaacagctaccccgcttgagcagacatcatcatggcgtcaacaaatgcgcgctatgtgcgctatctactaatcgccttcttcacaatcc

SEQ ID NO: 726 - DNA, 85 bp, Artificial Sequence
  Primer
tactaatcgccttcttcacaatcctcgtcttctactttgtctccaattcaaagtatgagggcgtcgatctcaacaagggcacctt

SEQ ID NO: 727 - DNA, 99 bp, Artificial Sequence
  Primer
gggtgaggctggcggggtcgccatcgagagcgctgactgactttggtgtcgtcttggtcgaatccggagctgtgaaggtgcccttgttgagatcgacgc

SEQ ID NO: 728 - DNA, 20 bp, Artificial Sequence
  Primer
gcagcttgactaacagctac

SEQ ID NO: 729 - DNA, 19 bp, Artificial Sequence
  Primer
gggtgaggctggcggggtc

SEQ ID NO: 730 - DNA, 61 bp, Artificial Sequence
  Primer
gcagcttgactaacagctaccccgcttgagcagacatcatcatggccattgcccggccggt

SEQ ID NO: 731 - DNA, 64 bp, Artificial Sequence
  Primer
gggtgaggctggcggggtcgccatcgagagcgctgactgagcccgtggctatcaagaagaagac

SEQ ID NO: 732 - DNA, 60 bp, Artificial Sequence
  Primer
gcagcttgactaacagctaccccgcttgagcagacatcatcatgttgaatccacgccgcg

SEQ ID NO: 733 - DNA, 59 bp, Artificial Sequence
  Primer
gggtgaggctggcggggtcgccatcgagagcgctgactgaggacgtcgaggccgattcg

SEQ ID NO: 734 - DNA, 61 bp, Artificial Sequence
  Primer
gcagcttgactaacagctaccccgcttgagcagacatcatcatgatgccacggcatcactc

SEQ ID NO: 735 - DNA, 60 bp, Artificial Sequence
  Primer
gggtgaggctggcggggtcgccatcgagagcgctgactgattcgagcttcaggtcatcgt

SEQ ID NO: 736 - DNA, 60 bp, Artificial Sequence
  Primer
gcagcttgactaacagctaccccgcttgagcagacatcatcatgctgctccccaagggcg

SEQ ID NO: 737 - DNA, 61 bp, Artificial Sequence
  Primer
gggtgaggctggcggggtcgccatcgagagcgctgactgactcagatgccgaagtggacac

SEQ ID NO: 738 - DNA, 116 bp, Artificial Sequence
  Primer
cttgagcagttaattaatttgaatggccggccgcacactttcaagattggcttcaagagagccaatcttgaaagtgtgcttgcgatcgcggatccacttaacgttactgaaatcat

SEQ ID NO: 739 - DNA, 116 bp, Artificial Sequence
  Primer
atgatttcagtaacgttaagtggatccgcgatcgcaagcacactttcaagattggctctcttgaagccaatcttgaaagtgtgcggccggccattcaaattaattaactgctcaag

SEQ ID NO: 740 - DNA, 116 bp, Artificial Sequence
  Primer
cttgagcagttaattaatttgaatggccggccgtacggtgttgccaagaagttcaagagacttcttggcaacaccgtacttgcgatcgcggatccacttaacgttactgaaatcat

SEQ ID NO: 741 - DNA, 116 bp, Artificial Sequence
  Primer
atgatttcagtaacgttaagtggatccgcgatcgcaagtacggtgttgccaagaagtctcttgaacttcttggcaacaccgtacggccggccattcaaattaattaactgctcaag

SEQ ID NO: 742 - DNA, 67 bp, Artificial Sequence
  Primer
ccgcttgagcagttaattaatttaaatggccggcctatatggcgcgccgtaagttttgcacagccgc

SEQ ID NO: 743 - DNA, 67 bp, Artificial Sequence
  Primer
gtcaagctgtttgatgatttcagtaacgttaagtggatccgcgatcgccgtactcgacgcccttgac

SEQ ID NO: 744 - DNA, 20 bp, Artificial Sequence
  Primer
ccttattcctttgaaccttt

SEQ ID NO: 745 - DNA, 20 bp, Artificial Sequence
  Primer
gcaacgtgctcaggagttgc

SEQ ID NO: 746 - DNA, 19 bp, Artificial Sequence
  Primer
gcacactttcaagattggc

SEQ ID NO: 747 - DNA, 19 bp, Artificial Sequence
  Primer
gtacggtgttgccaagaag

SEQ ID NO: 748 - DNA, 448 bp, Artificial Sequence
  Primer
gttgagtacatcgagcgcgacagcattgtgcacaccatgcttcccctcgagtccaaggacagcatcatcgttgaggactcgtgcaacggcgagacggagaagcaggctccctggggtcttgcccgtatctctcaccgagagacgctcaactttggctccttcaacaagtacctctacaccgctgatggtggtgagggtgttgatgcctatgtcattgacaccggcaccaacatcgagcacgtcgactttgagggtcgtgccaagtggggcaagaccatccctgccggcgatgaggacgaggacggcaacggccacggcactcactgctctggtaccgttgctggtaagaagtacggtgttgccaagaaggcccacgtctacgccgtcaaggtgctccgatccaacggatccggcaccatgtctgacgtcgtcaagggcgtcgagtacg

SEQ ID NO: 749 - DNA, 20 bp, Artificial Sequence
  Primer
tcttgagcacgacaatcgac

SEQ ID NO: 750 - protein, 526 aa, trichoderma reesei
MRPNSVLLAPLALYASGALAFYPYTPPWLKELEEHNAGEAKRSADNGLTFDIKRRASRRAPASQEEKAAWQAALLSHKYSESVTPSPSPDTTLSKRDNQFSILKAVDPDAPNTAGLAQDGTDYSYFVQASLGSKKTKLYMLLDTGAGSSWVMGTDCVSEACSLHDSFGPEDSDTLKTSTKDFSIAYGSGAVSGSLVNDTIEVAGMSLTYQFGLAHNTSSDFVHFAFDGILGMSMNSGANENFLSALEGAGLLDKSIFSVALARASDGHNDGEVTFGATNPSRYTGDITYTPIPSGTDWSIPLDDMSYNGKKGNVGGINAYIDTGTSYMFGPSKNVKALHAVIDGAKSSDGITWTVPCDTTTPLVVTFSGVDFAISPKDWISPKDSSGKCTSNVYGYEVVSGSWLFGDTFLKNVYAVFDKEQMRIGKTSPRATSPSSPAPTRTPSPATTSPSSASTPGSTPTTSSTRTARPSTSAPSGTSSTGAPSPSASANRDVLRAKRINMLKSISSFWHDPCCCLFLHVSISST

SEQ ID NO: 751 - protein, 534 aa, Trichoderma virens
MRPNTVLLAPLALFASGALAFYPYTPPWLKELEEHNAGEAKRSTENGMTFDIRRRASRRVSPTENSYRRLYMLTMICQAPASQEEKAAWQAALLAHKYNERSPPNPSHDSKLSKRGNQFHIMEAVDPKTPNTAGLDQDGTDYSYFVEALIGSQKTKLYMLLDTGAGSSWVMGSDCISQACSLHDSFGPKDSSTLKTSSKDFSIAYGSGSVSGSLVNDTIEVAGMSLPYQFGLATNTSSDFVHFAFDGILGMSMNSGANENFLSALESAGLLQKSIFSVALARASDGYNDGEVTFGATNPSRYTGSITYTSIPAGTDWSIPLDDMSYNGKKASAGGINAYIDTGTSYMFGPAKNVKALHSVIDGAQSSDGVTWTVPCDTTTPIVVTFSGVDHPISPEDWVSPKDSTGKCTSNVYGYEVVSGSWLFGDTFLKNVYAVFDKDQTRIGFAKRTGTTTGNKSIATATDTSIASATAASTGTATFEPPSTTEPAMGLSGQETATVAQPTQTTGSSGAASLLRSGSPTLVLCILPFLVLLV

SEQ ID NO: 752 - protein, 513 aa, trichoderma atroviride
MRSNTVLLAPLALFASGALAFYPYTPPWLKEIEEKHAGEARRSVEDGVTFDIKRRASRRAPVSQEQKAAWQAALLSHKYGSGDDASSSNTDSNIAKRDNQFNIMQAADPNAPDTAGLDQDGTDYSYFVQAELGSQKTKMYMLLDTGAGSSWVMGTGCTSPACALHDSFGPSDSSSLKTSSQTFNIAYGSGAVSGSLVNDTISVAGMSLTYQFGLASNTSSDFVHFAFDGILGMSMNSGANENFLSALEGAGLLDKSIFSVALSRASDGNNDGEVTFGSTNPSRYTGAITYTSIPDGTDWSIPLDDMSYNGKKGNVGGINAYIDTGTSYIFGPSKNVKALHAVIDGAQSSDGVTWTVPCDTTTPLVATFSGVDFAISPKDWISPKDSTGKCTSNVYGYEVVQGSWLFGDTFLKNVYAVFDKDQKRIGFAKRSTTGTGNKSIATATDASAASATGAATGTSTFEPPSPTAIGLSSQETSGAQPTQTKASSSASSFLRTGSPTIALCILPFLVLLV

SEQ ID NO: 753 - protein, 529 aa, Fusarium graminicola
MRPGALLAQLAFASSANAFFPYTPDWRVDVGQESVGRRSKTVGNGGGVRMGIKQRAPKSSQPLSERAAHEAARLIAKYTGGTVPATSVLAKRENEYNVMEAAKSTTKHTQGVNQDGTDYSYFIEVGVGSEKKPMYMLIDTGAGSSWVMGTSCTSKACTMHNTFGADDSDTLKETGKSFSIAYGSGKVSGNWATDTLTVAGMDINYQFGLTHTTSDQFLSFAFDGILGLAINKGSSGNFLNALAESKEVDKNMFCVALNRAADGTNEGEISFGSPNPDKYTGEISYTSLGKENDWAIEMDDMGYNGEQAGVGGLRSFIDTGTSFMFGSPANVKKVHALIDGAESKDGTTYHVPCDSKGNMTIKFSGVDHVISPKDWVSPPDKDGKCTSNLYGFEVVKGAWLLGDTFIKNVYAVFDADERRIGFATNAITSGSDSDDSEEETTSATVTKTSNKPTQTSDDSEETGITTNSKSTATAVPDMGLGKESVSSGTATAETSQASETQDSSAPSGLLSQARFTFIFCIVPFFALLT

SEQ ID NO: 754 - protein, 529 aa, Neurospora crassa
MVGIPKLLELTLLATSARAFFIWPPLPCDPGEPCYVSGSNDVRGKTLVGAGGQFHSPSPPGGEPAPDGFISLSVEQRNADPNESPEAGAARAARDAKRIAHRFASLDSTRVPKRRSGRLAARTNTYAVVEPESTNRKDSAGIYHDPSDYAYFAKVQFGSSKKPLYMLLDTGSSTAWIMGSTCKSDACIYHNLFGVDDSKTLKLQSKEFRLAYGTGAVAGTLARDTISVAGISLDMAFGLANETSSDFTHFAFDGILGLDMAVGGTDGFITELVNQKVLQSNIFAVTLGRASDPVNEGQITFGGVDPSKYTGDITYTNLVKDNRGAWIIPIDGFGFGGKKVTFQGRTTYIDTGTSFAFGPPADVTALHKLIPGSTTVDEVTWYVPCSDSPIEVTFSGVTFKISAKDWQAGSGTSCRSNIYGREVVANGWLLGDVFLKNVYSVFDVDKKRIGFAAKVEPVTITTTSGAQTSQTASGTTSSNDTPTSADATGQSTKGQSATPSGKDSAGYQLKSNAYALVLGIALMAAAIMA

SEQ ID NO: 755 - protein, 480 aa, Aspergillus niger
MHLPQRLVTAACLCASATAFIPYTIKLDTSDDISARDSLARRFLPVPNPSDALADDSTSSASDESLSLNIKRIPVRRDNDFKIVVAETPSWSNTAALDQDGSDISYISVVNIGSDEKSMYMLLDTGGSDTWVFGSNCTSTPCTMHNTFGSDDSSTLEMTSEEWSVGYGTGSVSGLLGKDKLTIANVTVRMTFGLASNASDNFESYPMDGILGLGRTNDSSYDNPTFMDAVAESNVFKSNIVGFALSRSPAKDGTVSFGTTDKDKYTGDITYTDTVGSDSYWRIPVDDVYVGGTSCDFSNKSAIIDTGTSYAMLPSSDSKTLHSLIPGAKSSGSYHIIPCNTTTKLQVAFSGVNYTISPKDYVGATSGSGCVSNIISYDLFGDDIWLLGDTFLKNVYAVFDYDELRVGFAERSSNTTSASNSTSSGTSSTSGSTTTGSSTTTTSSASSSSSSDAESGSSMTIPAPQYFFSALAIASFMLWL

SEQ ID NO: 756 - protein, 474 aa, Aspergillus fumigatus
MHLLQCLLSTISLASTVTAFVPYSFNLEVSTEGPPSNDVARRFVPWKLLLDDSYNNHGSSSNGVSLTLDLKKFPVRRDNKYKVVLADEPTTPNTAALNQEGLDYSYFATVRVGSQGQQMWLVLDTGGPNTWVFGSDCTTVACQRHETFGEAASKSLKLLPLNWAVGYGTGLVSGVLGTDSLSLAGLDVNMTFGLAKNASTDFESYPVDGILGLGRSANSNFNTPSFMETVATQRLLKSNIIGFSFSRNSDGARDGAANFGDLDTTRFTGDIVYTNTTGDSNNWRIPLDDASVNGTPCRFVNKTAVIDTGTSYAMLPPKDATVLHNLIPGAVTTSHGQNFTLPCNSTAVVQVSFSGLSYNISPKDYVGPAYGSACLSTIVGQALYGDDVWLLGDVFLKNVYSVFDYDNHRIGFANRSVPIASPTTTVAAAANPSATDGAGSTLTGSMAVHTGSASIVSRFVHWPFIFALLCMVLV

SEQ ID NO: 757 - protein, 567 aa, Aspergillus nidulans
MYRRSRASVGELVREQPVTSDFAEARLYLGRVMVSLRLAKWFAVQLLMEEELDIFNPPPSLHSFHPCRIMRLSQCLLSAAYLYTGVNAFIPYSFKIGLKTGSVDSPQRRFVPVKMLSGDISSETQHDEEGEGDSGSGDSLLSLDIKTHVRRDNIYKVVLADKPTSQNTVALHQDGLDYSYFSTVNIGTPGQPVWMMLDTGGANTWVFGADCTSEPCQMHNTFGDNSSSTVKTTSDTFMVGYGSGKVSGNLVTDRLKIADIDVQMTFGLATNATDDFRDYPIDGILGLGRSNDTSMGGRRAFMDLVTQEGDLDSNIVGFHMSRNSDGERNGTVTFGGVDKTKFEGDISYTNVVESSIHWSIPLDDASVNGESCGFMGKTAIIDTGTSYSLFPPDDAKTIHSLIPGSKQLSDENYLVPCDSTAKVQFTFSGVSYTMSPKDYIGANLESGDGCVSTIIAQAIFGDDVMILGDTFLKNVYSVFDFDNDRIGFAQLPGSDSPTTSTTTATVATPTDTFSTESDSDSTDSSTSTSTDPTGTSAEFTGTGSTAKVPAFFWPVATLLFLYLAAFL

SEQ ID NO: 758 - protein, 505 aa, Penicillium Wisconsin
MRLSSCLVFIAGISGVHAFYPWELRMKLSTETTVKRRFVPWTLIGAKSDDSTDSTDTSNAANRKPFTLDLKKVPVRRDHVYKIVESHKPSLADSAPLHQDGTDYSYFSPVYVGSQKQEMWMAIDTGAPNTWVFDSKCTEPVCIHHHTFDRSASTSFTTDNLAFSLFYGSGKIDGKMGKDTLSIAGLEVLQTFGLANNASETFESYPFDGILGLGRSHTSGWNLPSFMDLVAEKKLIKSNLVGFSLSRSEDNHKDGEINFGDVDTTKFDGTISYTATNDKNWNIPLDDAYVNGQSCNFSGRTATIDTGTTYLLIPPADAKALFSLVPDSSQQPDNPNNYLIPCNSTATIEFEFSGVKYNISPKDYVGNPEPEGSDYCISTIVGYASNGADWLVGDVFLKNVYTVFDFDNGQVGFGALASASASASALKSNLDPSSTSSSSSSSPPQGNGTFTAPLVTGTAASTADATSSSSPASSAMATVSGSSASHLVHGISWSMLTVMIAAFAV

SEQ ID NO: 759 - protein, 513 aa, Trichoderma reesei
MAVLSRLALTASFALCGVSAAGIQQPLTAPESLPPSHEAVADYGSKPIIDSEALQSAISIDTLVKRAESFYKFAKASEEEYGHPTRVIGSAGHEQTLNYITNTLLDHGDYYNVSVQEFPVTLSNVFQFRLVLADEVSKSAIPMGLTPPTKDKEPVHGDLVLVQNSGCDASDYPQNVKGNIAFIRRGACSFGDKSIGAGKAGAKAAVIYNTDPEELHGTLGLPVEDHIATFGIDGVEGKKILAKLSNGESVDAIAYIDAEVKQIQTVNVLAQTEEGDPDNCVMLGGHSDGVAEGPGINDDGSGSISVLEVAVQLTKFKVNNCVRFAWWAAEEEGLLGSDFYAASLSDEENQKIRLFMDYDMMASPNFAYQIYNATNAESPAGSEELRNLYVDWYKSQGLNYTFIPFDGRSDYDGFIRAGIPAGGIATGAEAVKTKEEAEMFGGRAGEWLDPCYHQLCDDLGNLNHTAWEVNTKLIAHSVATYALSFDGFPKRKLETEMSAYSQTTKHHGPKLIL

SEQ ID NO: 760 - protein, 515 aa, Trichoderma virens
MAVLSKLALAASFALCGVSAAGIQQQPLTAPSSLSSSHETAVDYSSKPLIDSEALQNAISIDALVKRAEKFYKFAQTSEEEYGHPTRVIGSSGHEETLNYIANTLLDLGDYYNVSVQEFPVTLSNVFQFRLVLADEVSKSAIPMGLTPPTKDKEPVHGDLVLVKNSGCNASDYPKNVKGNIAFIRRGECAFGDKSIGAGKAGAKAAVIFNTDPEELHGTLGLPVEDHIATFGIDGVEGKKIADKLADGESLDAIAYIDAEVKQIQTVNVLAQTEQGDPDNCVMLGGHSDGVAEGPGINDDGSGSMSVLEVAVQLTKFKVNNCVRFAWWAAEEEGLLGSDFYAENLSEEENQKIRLFMDYDMMASPNFAYQIYNATNAESPAGSEELRNLYVDWYKSQGLNYTFIPFDGRSDYDGFIRAGIPAGGIATGAEAVKTKEEEEMFGGHAGQWLDPCYHQLCDDLGNLNHTAWEVNTKLIAHSVATFALSFEGFPKREVESETISAYGQTMKHHGPKLIL

SEQ ID NO: 761 - protein, 511 aa, Trichoderma atroviride
MAVLSRLALTASFALSASAAGLGGSWQQSPLTSPSSLSSSQGSKPLISTEALQEAISIDALVERAQKFYKFAQTSEEDYGHPTRVIGSTGHERTLNYIVNTLLDQGDYYTISTQEFPVTLSNVFESQLVLGSSVSKSAVPMGLTPATRDREPVHGQLVLVNNDGCHDSDYPKNVKGNIAFIRRGACAFGDKSIGAGKAGAKAAVIYNTDPEELHGTLGEPTKYHVATFGIDGTEGNAVAEKLAKGESVSAIAYIDAEVKQIQTVNVLAQTDEGDPDNCVMLGGHSDGVAEGPGINDDGSGSMSVLEVAVQLAKFKVNNCVRFAWWAAEEEGLLGSDFYAASLSEEENQKIRLFMDYDMMASPNFAYQIYNATNAYNPAGSEELRDLYVDWYKSQGLNYTFIPFDGRSDYDGFIRAGIPAGGIATGAEAVKTKEEEEMFGGHAGQWLDPCYHQICDDLGNLNHTAWEVNTKLIAHSVATYALSFDGFPKREQETKISSYSETIKQHGPKLIM

SEQ ID NO: 762 - protein, 510 aa, Fusarium graminicola
MTTKSFCLVAATAALSGVSALQIPLNLQVPKLSWSPFSDDLPLVDTKELQKSIKPENLEARAKDLYEIAKNGEEEYGHPTRVIGSEGHLGTLSYIHAELAKLGGYYTVSNQQFPAVSGNVFESRLVLGNDVPKEAAPMGLTPPTKNKEPVYGKLVLVDNEGCNESDYPEAVKGNIALVLRGTCPFGTKSGNAGKAGAVAAVVYNYEKGDVHGTLGTPSPDHIATFGLGGDEGKAVVKKIKDGEEVDAIAYIDAEVKTISTTNIIAQTRGGDPDNCVMLGGHSDSVAEGPGINDDGSGSISVLEVAVQLTKYRVNNCVRFAWWAAEEEGLLGSDHYVSVLSDEENQKIRLFMDYDMMASPNFAYQIYNATNAANPKGSEELRNLYVDWYEEQGLNYTFIPFDGRSDYDGFIRGGIPAGGIATGAEGVKTEEEVAMFGGEAGVWYDKNYHQIGDDLTNVNYTAWEVNTKLIAHSVATYAKSFKGFPERSSEAVVQSETYSDKTKYHGSKLFL

SEQ ID NO: 763 - protein, 502 aa, Aspergillus nidulans
MRPAAVSLGLIGGISALGIPLPETLEQLPLSDAQKPLVSSEGLQAQIHVSNLLDRAKVLYSLAERGIDEYNHPTRVIGSKGHWGTLDYIYSTIMELGDYYDVTNQSFPAVSGNVFESRLVLGHEVPASARPMGLTPPTKNREPVYGSLILVSNEGCDKADYPSELAGAIALIQRGTCPFGTKSELAGKAGAVAAVVYNNEHGEVSGTLGTPSPYHVATFGISDTDAAPYVQQLKEGKKVDSIAYIDATVDTIYTTNIIAQTRRGDPENCVMLGGHSDSVAEGPGINDDGSGTLTLLEVATQLSKYDVNNCVRFAWWAAEEEGLLGSDYYVSVLSEEENLKIRLFMDYDMLASPNFAYQVYNATNEVNPVGSEELRDLYTEFYTSHGLNFTYIPFDGRSDYDGFIRNGIPGGGIATGAEGVKTDEEQEMFGGIAGNWYDPCYHQLCDDLGNVNATAWEVNSKLVAHTVATYAVSFEGFPKRTTTNVKSVDLEKRKYHGPKLLM

SEQ ID NO: 764 - protein, 508 aa, Aspergillus niger
MRIDSAALHLVPVLLGQVGALQLPLVQDSNSQWQKPNAGDKPLISSPLLQEQVKAENLLDRARQLYKIAELGEDEYNHPTRVIGSKGHLGTLDYIYSTLTDLGDYYTVVNQSFPAVSGNVFESRLVLGHDVPKSATPMGLTPPTRNKEPVYGSLVAVSNLGCEASDYPSNLKGAVAFISRGSCPFGTKSQLAGKAGAVAAVIYNNERGDLSGTLGNPTPDHVATFGISDEDAAPVLEKLNKGEKVDAIAYVDAIVETIHTTNIIAQTTDGDPNNCVMLGGHSDSVAEGPGINDDGSGTLTLLELATLLTQFRVNNCVRFAWWAAEEEGLLGSDYYVSVLTPEENRKIRLFMDYDMLGSPNFAYQVYNATNAVNPEGSEELRDLYTDFYEDHGFNYTYIPFDGRSDYDAFIRHGIPGGGIATGAEGIKTVEEADMFGGVAGQWYDPCYHQICDTVANVNLTAWEWNTKLVAHSIATYAKSFDGFPERSDEPISPAAFEEPKYHGHALQL

SEQ ID NO: 765 - protein, 503 aa, Aspergillus oryzae
MRLQLPEVAIATLLLGEVGAVQLPLLQSQVPITSDKELVSSSAFQSHVKAENLLKRAKELSKIADLGEEEYNHPTRVIGSKGHLGTIDYIYSTLAKLGDYYTITNQSFPAVTGNVFESRLVLGDAVPESAAPMGLTPPTKNKQPVHAPLVAVSNFGCDASDFPSDVSGAIALISRGTCPFGTKSELAGKAGAVAAVVYNNEKGSLSGTLGNPTPDHVATWGLSDEDAAPILEKLEKGEEVDGIAYMDAIVETIHTTNIIAQTTEGDPENCVMLGGHSDSVAEGPGINDDGSGSLTLLELATLLTQYRVNNCVRFAWWAGEEEGLLGSDYYVSVLTPEENLKIRLFMDYDMLGSPNFAYQVYNATNSVNPVGSEELRDLYVDFYNDHDLNYTYIPFDGRSDYDAFIRHGIPGGGIATGAEGIKTPEEQEMFGGVAGAWYDPCYHQICDVVGNVNLTAWELNTKLVAHSVATYARSFEGFPKRTKDSITAFATENNKYHGPRLVL

SEQ ID NO: 766 - protein, 524 aa, Aspergillus fumigatus
MVASTIHLLCTAFALTAEGAALQLPLFGASEPQIPVAGKELISSSALQSQIDVGKLLNRAKHLYSIAELGSDEYNHPTRVIGSKGHLGTLDYIYATLTEFDDYYTISNQTFPAVTGNVMESRLVLGHTVPESALPMGLTPPTKNHEPVYGPLVLVSRLGCEAADYPPELQGAIAFISRGSCPFGTKSALAGKAGAVAAVIFNNEKGGLGGTLGTPSPDHVATFGLSDSDAAPFLEQLRRGQKVDAIAYMDATVETITTTNIIAQTKEGDADNCVMAGAHSDSVMEGPGINDDGSGSLTLLEIASLLPHYRVNNCVRLAWWAGEEEGLLGSDYYVSVLSEAENLKIRLFMDYDMLASPNFAYQVYNATNAVNPVGSEQLRDLYTEFYEAHGLNFTYIPFDGRSDYDAFIRNGIPGGGIATGAEVIKTEEEQKMFGGVAGDAFDPCYHQLCDDVSNVNLTAWEVNTKVRVDFCVYTRRRLLICTQLVAHSIATYARSFDGFPKRIKVESMKKGDEQRKYHGHSLLY

SEQ ID NO: 767 - protein, 511 aa, Myceliophthora thermophila
MRTPAASLLAFALPALATAGGHGGSSGLGCDSQRPLVSSEKLQSLIKKEDLLAGSQELQDIATAHGGHRAFGSSGHNATVDFLYYTLKALDYYNVTKQPFKEIFSSGTGSLTVDGEDIEAETLTYTPSGSATDKPVVVVANVGCDAADYPAEVAGNIALIKRGTCTFSQKSVNAKAAGAVAAIIYNNAEGKLSGTLGQPFLDYAPVLGITLEAGEALLAKLAGGPVTATLQIDALVEERVTYNVIAETKEGDHSNVLVLGGHTDSVPAGPGINDDGSGTIGMLTVAKALTKFRVKNAVRFAFWSAEEYGLLGSYAYIKSINSSAAELSKIRAYLNFDMIASPNYIYGIYDGDGNAFNLTGPAGSDVIERNFENFFKRKHTPSVPTEFSGRSDYAAFIENGIPSGGLFTGAEVLKTEREAELFGGRAGVAYDVNYHQAGDTVDNLALDAFLLNTKAIADSVATYALSFDGLPRVDGKKRRWDAHRARMLKRSAGSHGHAHLHSGPCGGGASI

SEQ ID NO: 768 - protein, 492 aa, Fusarium graminicola
MKYSTILALAGLASASTPKKPLVNELKLQKDITLKGLMAGAQKLQDIAEANDDTRVFGGKGHNATVDYLYNTLKSLNYYNVKKQPFTELYSAGTASLKADGEDIAAAIMTYTPAGEASGPLVVAANLGCEASDFPAESKGKVVLVKRGECAFSAKSTNGKTAGASAVIVYNNVAGELSGTLGEPFGNFAPIVGISLESGEAILAKTKAGEVKVDLKVDATVENRVTFNVIAETKEGDHDNVLVVGGHSDSVAAGPGINDDGSGIIGILNVAKALTKYRVKNAVRFGFWSAEEFGLLGSYAYMKSINSSDTEIAKIRAYLNFDMIASPNYVYGIYDGDGDAFNLTGPAGSDAIEKDFEKFFKTKRLASVPSEFSGRSDYAAFIENGIPSGGLFTGAEQLKTEEEAKKFGGEAGVAYDINYHKAGDTIDNLNKEAFLVNTQAIANSVAKYAKSFKGIPQVNHLTRRRDADHAQIFKRTSAHTHAHGGPCGAVEV

SEQ ID NO: 769 - protein, 493 aa, Penicillium chrysogenum
MKWSLLITHLSVAFAEAGRRKPLVSPDEFPSAIRLKDLLKGTQQLEDFAYAYPERNRVFGSAAHNDTVDYIYRELKKTGYYHVWKQPQVHTWTTAKTSLTFDGESIEATAMTYSPSADVTAEMAVVSNLGCSASDYPSGVAGGIALVQRGECSFGEKSVLAAAAKASAVIIYNNEAGPVSGTLGGVTNELGPYAAIAGISDVDGKTLLDAAAKGAVTLSVSIDSRVENRTTFNVIAETKGGDHNNVVSLGGHTDSVDAGPGINDDGSGVISNLVVAKALTRFSVKNAVRFFFWTAEEFGLLGSEYYTSHLDADELAKIRLYLNFDMIASPNYALMIYDGDGDAFNQTGPAGSAEIEALFEDYYKSKKLPYIPTAFDGRSDYDGFISRGIPAGGIFTGAEGAKTEEEAKLFGGEAGVAYDVNYHAAGDDFKNLNHEAFLINSKATAFAVAKYANSLASIPRHSATPTKRVVKKRAPRSHAHTKNTGCFHSLVEI

SEQ ID NO: 770 - protein, 501 aa, Aspergillus fumigatus
MVTMKLLYLTSFASLAVANGPGWDWKPRVHPKVLPQMIHLWDLLQGAQQLEDFAYAYPERNRVFGGRAHEDTVNYLYRELKKTGYYDVYKQPQVHQWTRADQALTVDGQSYDATTMTYSPSVNATAPLAVVNNLGCVEADYPADLTGKIALISRGECTFATKSVLSAKAGAAAALVYNNIEGSMAGTLGGATSELGAYAPIAGISLADGQALIQMIQAGTVTANLWIDSQVENRTTYNVIAQTKGGDPNNVVALGGHTDSVEAGPGINDDGSGIISNLVVAKALTRFSVKNAVRFCFWTAEEFGLLGSNYYVNSLNATEQAKIRLYLNFDMIASPNYALMIYDGDGSAFNLTGPAGSAQIERLFEDYYTSIRKPFVPTEFNGRSDYQAFILNGIPAGGLFTGAEAIKTEEQAQLFGGQAGVALDANYHAKGDNMTNLNREAFLINSRATAFAVATYANSLDSIPPRNMTTVVKRSQLEQAMKRTPHTHTGGTGCYKDRVEQ

SEQ ID NO: 771 - protein, 496 aa, Aspergillus oryzae
MRSLLWASLLSGVLAGRALVSPDEFPEDIQLEDLLEGSQQLEDFAYAYPERNRVFGGKAHDDTVNYLYEELKKTGYYDVYKQPQVHLWSNADQTLKVGDEEIEAKTMTYSPSVEVTADVAVVKNLGCSEADYPSDVEGKVALIKRGECPFGDKSVLAAKAKAAASIVYNNVAGSMAGTLGAAQSDKGPYSAIVGISLEDGQKLIKLAEAGSVSVDLWVDSKQENRTTYNVVAQTKGGDPNNVVALGGHTDSVEAGPGINDDGSGIISNLVIAKALTQYSVKNAVRFLFWTAEEFGLLGSNYYVSHLNATELNKIRLYLNFDMIASPNYALMIYDGDGSAFNQSGPAGSAQIEKLFEDYYDSIDLPHIPTQFDGRSDYEAFILNGIPSGGLFTGAEGIMSEENASRWGGQAGVAYDANYHAAGDNMTNLNHEAFLINSKATAFAVATYANDLSSIPKRNTTSSLHRRARTMRPFGKRAPKTHAHVSGSGCWHSQVEA

SEQ ID NO: 772 - protein, 503 aa, Aspergillus nidulans
MKSILVPALSLASLAWAGKHKPLVTPEALQDLITLDDLLAGSQQLQDFAYAYPERNRVFGGRAHDDTVNWLYRELKRTGYYHVYKQPQVHLYSNAEESLTVNGEAIEATTMTYSPSANASAELAVISGLGCSPADFASDVAGKVVLVQRGNCTFGEKSVYAAAADAAATIVYNNVEGSLSGTLGAAQSEQGPYSGIVGISLADGEALLALAEEGPVHVDLWIDSVMENRTTYNVIAQTKGGDPDNVVTLGGHSDSVEAGPGINDDGSGIISNLVIARALTKFSTKHAVRFFFWTAEEFGLLGSDYYVSSLSPAELAKIRLYLNFDMIASPNYGLLLYDGDGSAFNLTGPAGSDAIEKLFYDYFQSIGQATVETEFDGRSDYEAFILNGIPAGGVFTGAEEIKSEEEVALWGGEAGVAYDANYHQVGDTIDNLNTEAYLLNSKATAFAVATYANDLSTIPKREMTTAVKRANVNGHMHRRTMPKKRQTAHRHAAKGCFHSRVEQ

SEQ ID NO: 773 - protein, 508 aa, Neurospora crassa
MRTAAASLATLALAVPALAATIQGGPTRKPYVCSDALQYQITEKDIRAGAQKLQDIANANNGTRVFGSTGHNATVDFLYNTLKDTGYYDVYKQPFVETYSAGTGSLSVNGKALDVRIMTYTPAGSATGPIVYAEGLGCSAAEYPAEASGNIVLVSRGNCTFGQKALSAKEAGAVGLVIYNNVDGSLSGTLGEAFKDYAPVVGLSKEDGEALIASIKGGEEIKAEFKVDAVTEHRVSFNVIAETKGGDHNNVLIVGGHSDSVAAGPGINDDGSGVIGILTVAKALAKFQVKNAVRFGFWSAEEFGLLGSEYYVKSLNGSKTELAKIRAYLNFDMIASPNYIYGIYDGDGSAFNLTGPQGSDVIEKDFEQFFSKNKVASVPSEFNGRSDYAAFIENGIPSGGIFTGAEGIKTEAEAAAVGGTAGIAYDVNYHQAGDTIDNIAWDAFLLNTRAIANSVAKYARSFKSLPAINLMQRRWDGDVAQTLKRNKKRANGAHVHSHSGPCGGGEEI

SEQ ID NO: 774 - protein, 493 aa, Myceliophthora thermophila
MRLLRTAGAATLFLSPATFATNNPLTPGKLEADIRTEELQNVLWNLNHIAVTHGGNRAFGEPGYKASLDFILERAQTRFHNEFDTVVQPFNHTYGKTNQIKVTGPEGEDVFVISPLYNPATPLPDGITAPLVDTPVDDERGSACFPDQWEGVDVKGKLVLVKRGICAVADKSALAKERGALGVILYNEQPGTNIVVPTLGAESIGKTVPIGIIPLEVGQSWKSRLADGEEVTVHLLVDSISDTRETWNIIAETKQGDPDKVIMLGAHLDSVQAGAGINDDGSGTAALLEILTAVRRYDGFPHKIRFAWWAAEESGLVGSLYYTSHLTEEEADRIKYYFNYDMIGSPHPDFEIASDGNSGVGPQLLEEYLVEQGKEIVHGGFGSGSDFVGFLELGIPSTALHTGAGAPFDECYHQACDDLDNINWEALTVNAKAAARAAARLANSLEGVPPRKKTSLNLHTRRGVVQNFRKWASLAEEASHGHTCSHTGKRVVV

SEQ ID NO: 775 - protein, 605 aa, Trichoderma reesei
MAATRDPTTLSNYGAWRTKHTSASFNIDFDNKRLVGSVVLQLESQTDKQSTEIVLDSRFVKVSSVAVDGAAAQWELKPHSDPFGAPLHIQVPHGAAKGDVVRVAIELETTSKCTALQWLTPAQTSNKKHPYMFSQCQAINARSIFPCQDTPDVKSTISFKFTSTLPVVASGVAVGDHTATPGVEKVYEFEQKVPIPSYLFAVASGDIVAAPIGSRSKVVTGPNELKGCQWELERDMEKFLEIAESIVFPYRWGEYNVLVLPPSFPYGGMENPIYTFATPTIISGDRQNVDVIAHELAHSWSGNLVSNASWEHFWLNEGWTVYLERRIEAAVHGEPQFDFSSIIGWKALEDAVAHFGKDHEYTKLIISHDNVDPEDVYSTVAYEKGFHFLYYLDRLVGRDNFNKFIPHYFTKWAGKSLDSFEFRDTFVDFFNNLGDEEVKQKVATIDWEGRFYTPGLPPKPEFDTTLASQCYELAEKWKDASYEPSPKDVEGFSSNQKIVFLEKLQQFEPLSTDRAQLLGKVYDLLNTQNVELKFAYLQLALKANDASSYQTTADLLGKVGRMKFVRPLFRSLNKVDRNLALETFAKNKDFYHPICRGMVEKDLGV

SEQ ID NO: 776 - protein, 636 aa, Trichoderma virens
MSWFSLRVGLLRSTNRIITSYARRGFATINTMAGTRDPTTLSNYGAWRTRHTTANFNIDFENKRLKGSVVLQLESQTDKESKEIILDSRFVNVSSVNVNDTASKWELKPHSDPFGAPLHVQVPDGAAKGEIVHLAIELETTSKCTALQWLTPAQTSNKKHPYMFSQCQAINARSIFPCQDTPDVKSTISFKFTSTLPVVASGVAVGDHTATPGVEKVYEFEQKVPIPSYLFAVASGDIVAAPIGSRSKVVTGPNELKGCQWELERDMEKFLEIAESIVFPYKWGEYNVLVLPPSFPYGGMENPIYTFATPTIISGDRQNVDVIAHELAHSWSGNLVSNASWEHFWLNEGWTVYLERRIEAAVHGEPQFDFSSIIGWKALEDAVAHFGADHEYTKLIISHDNVDPEDVYSTVAYEKGFHFLYYLDRLVGRDNFNKFIPHYFTKWAGKSLDSFEFRDTFVDFFNNLGDEEVKQKVATIDWEGRFYTPGLPPKPEFDTTLAGQCYELAEKWKDASYVPNAKDIESFSSNQKIVFLEKLQQYEPLSSERAQLLGSAYDLLNTQNVELKFAYLQIALKANDSTSYQTTADLLGKVGRMKFVRPLFRSLSKVDRSLALETFAKNKDFYHPICRGMVEKDLGV

SEQ ID NO: 777 - protein, 604 aa, Trichoderma atroviride
MAKRDPTTLSNYDAWRTKHTTASFSIDFDNKRLKGSVVLQLESQTDKQSNEIILDSRFVKVSSVNVNSAESKWELKPHSDPFGAPLHVQVPDGAAKGDIVNLAIELETTSKCTALQWLTPAQTSNKKHPYMFSQCQAINARSIFPCQDTPDVKSTISFKFTSTLPVVASGVAVGDHTATPGVEKVYEFEQKVPIPSYLFAVASGDIVSAPIGSRSKVVTGPNELEGCKWELERDMEKFLEIAESIVFPYKWGEYNVLVLPPSFPYGGMENPIYTFATPTIISGDRQNVDVIAHELAHSWSGNLVSNASWEHFWLNEGWTVYLERRIEAAVHGEPQFDFSSIIGWKALEDAVAHFGKDHEYTKLIISHDNVDPEDVYSTVAYEKGFHFLYYLDRLVGRENFNKFIPHYFTKWAGKSLDSFEFRDTFVDFFNGLGDEDIKKKVATIDWEGKLYTPGLPPKPEFDMTLAGQCYELAAKWENDSYEPSAKDVESFSSNQKIVFLEKLQQHGALSTERAQLLGKVYSLLDTQNVELQFAYLQIALKANDSTSYQSTADLLGKVGRMKFVRPLFRSLNKVDRSLALETFAKYKDFYHPICRGMVEKDLGV

SEQ ID NO: 778 - protein, 639 aa, Fusarium graminicola
MSWFSSLKKPSILRTCQVTITHNLRRTFATVNPNMTANRDPSTLSNYSAWRTRHTTANFKIDFDQKALKGSVVLQLESQTDKESKEIILDTRYVDISSISIDSKESKWELKSFNAPLGAPLHIAVPDGVAKGELIDLAIDLQTTSKCTALQWLTPAQTSNKKHPYMFSQCQAINARSIFPCQDTPDVKSTFSFKLTSSLPVVASGVPVGDHEATPGKEKLYEFEQKVPIPSYLFAVASGDIATAPIGPRSIVATGPNELEGCKWELERDMEKFMEVAEKLVFPYKWGAYNVLVLPPSFPYGGMENPIYTFATPTIISGDRQNVDVIAHELSHSWSGNLVSNASWEHFWLNEGWTMYLERRIQAAIHGDAEFDFSAIIGWKDLENAVELFGKDHEYTKLIIKHEGVDPEDVYSTVAYEKGFHFLYYLEGVVGRENFDKFIPFYFTKWSEKSLDSFEFKQTFLDFFNNLGNKEVAKKITEINWEEKFYTPGLPPKPEFDTTLANQCYDLANKWKDAKFEPNANDLEEFTANQKLVFLGEVQQSGDLTADRVQLMGKTYDFMSSKNVEILSAYYQIALQAKDSAIYQAAADLLGTVGRMKYVRPLFRALNKVDRQLALDTFEKNKDFYHPICKGMVEKDLGL

SEQ ID NO: 779 - protein, 614 aa, Neurospora crassa
MAPVRDPNTLSNYDAWRTRHTTANLKIDFTAKCLRGSVILELESQTDKASKEIVLDSSYVTVNSIKLNSAPSLWETKARTEPNGSPVHIAVPEGAAKGEVVKVEIELATTDKCTALQWLTPAQTSDKAAPFMFSQCQAIHARSLFPCQDTPDVKSTYDFNITSPYVVVASGVPVPDETKDLGEEKLYKFQQKVPIPSYLFALSSGEIASAPVGKRSCVCTGPNELKASQWELEGDMDKFLEAAEKIVFPYRWGEYNVLVLPPSFPYGGMENPIFTFATPTIISGDKQNIDVIAHELAHSWSGNLVTSCSWEHFWLNEGWTMYLERRILASIHGGDAHFDFSAIRGWKALEEAIKEYGEDHEFTKLCISHKGIDPDDAFSTVPYEKGFHFVWSLDRLVGRENFDKFIPYYFGKWSNKSLDSYEFKDTFLEFFSAPEYSDLKDKIASIDWEGRFHSTGLPPKPEFDTSLADVCYELAEKWKSKDFTPSPSDVASWTGNQVLVFLNAVQDFEEPLTVEQSQALGKAYGLSESKNAELKAAYYHIAMRSKDASAYQGVADLLGEVGRMKFVRPLFRGLNKVDRELALKTFEKNREFYHPICRQMVEKDLGVSEAANSS

SEQ ID NO: 780 - protein, 613 aa, Myceliophthora thermophila
MAPVRDPNTLSNYDQWRTRHTTANFKVDFAAKCLRGSVILELESQTDKASREIILDSSYVDVSAIKLNSTPSQWVIKDRTGPNGSPVHVAVPNGAAKGEVVKLEIELATTEKCTALQWLTPAQTSNKKAPFMFSQCQAIHARSIFPCQDTPDVKSTYEFNIRSPHVVVASGVPVPGATVDAGEDKIYKFEQKVPIPSYLFAVASGDIASAPIGRCSSVATGPNELKASQWELQDDMDKFLDAAEKIVFPYQWGEYNVLVLPPSFPYGGMENPIFTFATPTIISGDRQNIDVIAHELAHSWSGNLVTSCSWEHFWLNEGWTVYLERRILAAIHKNDAYFDFSAIIGWKHLEEAIEGFGKDHEYTKLSIKHDGIDPDDAFSTVPYEKGFHFIWSLDRLVGRENFDKFIPYYFKKWQNKSLDSYEFKDTFLEFFGAPEYAGLKDKLAEIDWEGRFFNTGLPPKPEFNTSLVDVCFQLAEKWKQKDYTPSPSDISSWTGNQVLVFLNAVQDFEEPLTVGQSQNLGKIYGLADSKNAELKSAYYQIAMKAKDTSSYPGVAELLGNVGRMKFVRPLFRSLNKVDRDLALGTFEKNRDFYHPICRQLVEKDLGVGEAKSS

SEQ ID NO: 781 - protein, 662 aa, Aspergillus oryzae
MIRIPLFQPWKPRLPRGSVVHSCYFIPFSEVTTRIPWIAQASRRSMATVIHSPRDPNTLSNYNNWVSTHITATFDILFEQKKLVGNVVHKLKSITDARSTEIILDTNHVDIGDVKVDGQASHWELLPPLEPYGAALKINLDQGVGLNEMVEVEISVKTTEKCTALQWLTPAQTSNRKHPYMFSQCQAIHARSIFPCQDTPDVKSTIDFNITSPLPVVASGLPVRGIIEKAQPGSKTLYQFHQKLPIPSYLFALASGDISEAAIGPRSVVATSPDKLSECQWELKADTENFIHAIEKIVYPYAWGEYNVLILPPSFPYGGMENPIFTFATPSIISKDRENVDVIAHELAHSWSGNLVTNASWEHFWLNEGWTTYLERRILAAVHGEAYRHFSAIIGWKSLADSVEHFGHDHPFTKLVTDLKGKDPDDAFSSIPYEKGFNFLFHLENLLAKDKFDRFIPHYFTKFKGKSLDSYEFKATMLEFFQHDLEASNLLKNVDWDAWFYAPGLPPKPQFDTSLVDVVYELSSKWKSLPDSSFQPRTSDIEGLTANQIVVLLEQILLFERPLTPELSRVLGEVYSLAKSENIEVSNLYFQVGLRAGDDTVYKPTAELLGKIGRMKFVRPLYRNLQKVNRPLAIETFEKNKDFYHPICRAMVEKDLFGKREE

SEQ ID NO: 782 - protein, 664 aa, Aspergillus niger
MQPIPFTLFWRISSPRVPCFTGLKANVNSSIQVRWSLRLPQIHRRSMAISIHPPRDPNTLSNYNNWICTHITANFDILFDQKKLVGNVIHKLKSTTNGESQEIILDSNHVAIGDVKIDGRPSEWELLPPLEPYGSALKIKLDQGVNLNETIDVEISVQTTEKCTALQWLTPAQTSNKKHPYMFSQCQAIHARSIFPCQDTPDVKSTIDFNISSPLPVIASGLPVRDALGASKSEGKSLYQFHQRVPIPSYLFALASGDISEAAIGPRSVVATSPDKVQECQWELEADTEKFIGAIEKIVYPYAWGEYNVLILPPSFPYGGMENPIFTFATPSIISKDRENIDVIAHELAHSWSGNLVTNASWEHFWLNEGWTTYLERRILAAVHGEAYRHFSAIIGWKALTDSVEHFGHDHEFTKLITDLKGKDPDDAFSSIPYEKGFNFLFHLETLVGKQKFDRFIPHYFTVFKGKSLDSYEFKATLLDFFGTDAEASKLLNDLDWDTWFYAPGLPPKPQFDTSLVDVVYELAQKWKSLSETSSFKPQLSDIESLSANQIVVFLEQMLLLERPLTPELSKLMGEVYGLSKSENIEVANLYFQLGLKAGDENVVDPATELLGRIGRMKFVRPLFRSLQRVNREVAVATFEKYKDFYHPICRAMVEKDLFGKRDV

SEQ ID NO: 783 - protein, 639 aa, Aspergillus nidulans
MTTTTTTTTTTTLPFNLYGRSMATLMNPVRDPNTLSNYNNWLCTHTTANFEIFFEEKKLVGNVVHKLRSITNAETDEIILDSHHVDIRNVQVAGLPVKAWELLPPLGPYGTALKIKLENPVGLNEIIDVDIAVQTTKECTALQWLTPAQTSNKKHPYMFSQCQAIHARSIFPCQDTPDVKCTFDFNITSPLPVIASGLPVRSTSTVPQSGVKTLHRFHQKVPIPSYLFALASGDIAEAAIGPRSVVATSPDKLEECKWELEADTERFIKTIEEIIYPYAWGEYNVLILPPSFPYGGMENPVFTFATPSIISKDRENVDVIAHELAHSWSGNLVTSASWEHFWLNEGWTVYLERRILASLHGEKYRHFSAIIGWKALRDSVEHYSHDHEFTKLVPNLKGEDPDDAFSTIPYEKGFNFLFHLENLVGKEKFDRFIPHYFTTFKGKSLDSYDFKATLLDFFKSDAEASRLLQELDWDSWFYKPGLPPKPEFDTSLADVVYELAGKWRSLPESPFQPQPSDIQGLTANQIVVFLEQILLFERPLTAELSKLMGEVYGLTGSENIEVANLYLQVGLKAADKSVIGPTTDLLGRIGRMKFVRPLYRALQKVDRQVAIDTFEKHKDFYHPICRGMVEKDLFGKKDA

SEQ ID NO: 784 - protein, 614 aa, Aspergillus fumigatus
MTTVVNLPRDPNTLSNYNNWVSTHITANFDILFDQRKLAGNVIHRFRSTTDGESNHIILDTNHLDIGSVKVNGQPSEWEYLPRLEPYGTPLKIKLDQGVKLNETIEVDISVQTTEKCTALQWLTPAQTSNKKHPYMFSQCQAIHARSIFPCQDTPDVKCTLDFNITSPLPVIASGLPVRGSSEAPKSDGKTLYKFHQKVPIPSYLFALASGDISEAPIGPRSVVATSPDKLGECQWELEADTEKFINAIEKIVYPYVWGEYNVLILPPSFPYGGMENPIFTFATPSIISKDRENIDVIAHELAHSWSGNLVTNASWEHFWLNEGWTTYLERRLRHGEPYRHFSAIIGWKALTDSVEHFGPEHDFTKLITNLKGMDPDDAFSSIPYEKGFNFLFHLENLVGKSKFDRFIPHYFNKYKGKSLDSYEFKSTILDFFKDDSDASTALNELDWDSWFYAPGLPPKPDFDTSLVDVVYDLAKKWLSLPKSSFKPQPEDIRGLTANQVVVFLEQILVSERQLTPELSKLMGEIYGLAASQNIEVANLYFQVGLQAGDASVVEPTADLLGKIGRMKFVRPLYRKLAKFDRKRALDTFEKHKGFYHPICRAMVEKDLFGKKDE

SEQ ID NO: 785 - protein, 666 aa, Penicillium chrysogenum
MGNEKWQMANGLMGEKFLSSMNPTLGRSLTRNLNFNLVRTSFKLQFTSIRTMATINPPRDPNTVSNYNNWRSTHITANFDILFDQKKLVGNVVHQFKSITDGESQEIILDTSHLDIGVVKVDGQPSKWKFLPPLEPYGVPLKICLDKPIKLNGTVEVDIEVKTTDKCTALQWLTPAQTSNKKHPYMFSQCQAIHARSIFPCQDTPDVKATFDFNITSPLPVMTSGLPIRKSSMESKADHQLYRFHQSVPIPSYLFAIASGDVAEAPIGPRSVVATSPDKLEECKWELEADTENFITTIEKIVYSYAWGEYNVLILPPSFPYGGMENPIFTFATPSIISKDRENIDVIAHELAHSWSGNLVTNASWEHFWLNEGWTVYLERRILAAIHGEAYRHFSAIIGWKSLTDAVEHFGDDHEFTKLIVDLKGKDPDDAFSSVPYEKGFNFLFYLENLVGKSKFDKFIPHYFTTFKCKSLDSYEFKALILDFFQSDAEASKLLDELDWDKWFYAPGLPPKPRFDTSMVDVVYELSKKWQSLPDSSFKPQISDIQGLTANQLVVFLEQMLLLEKPLSPETSKLMGDVYGFTKSENIEVSNLYCQVGMKAGDDSVIEPTTELLGRIGRMKFVRPLFRNLQKINRPVALATFEKYKDFYHPICRGMVEKDLFGKKDN

SEQ ID NO: 786 - protein, 533 aa, Trichoderma reesei
MWSLAVAAELLLLAGTASALLFQDLRPPKPDVDLDNNFRIAAAASTPTYGTFQQLIDHDHPELGTFSQRYVWNDEFYAGPGSPIILMGPNESALDGYERYTTNLTLPGVMAQELGAGALIIEHRYWGQSSPFDSLTTENMRYLTLEQSVQDLVYFAQNVVLPFDQNRTSTPDKAPWVLVGCSYSGALAAWVQDLAPGTFWAYQCSSPVVEAIGPLWKYFEQVKLAMPQNCTADYARIVQYIDGVLLGHNQKAKDELKASFNLGDVEHDDDFAAALVSGLYTWQSVLFSDGYSATNRMCDYVENQWPGSTAPAPGKNGVGLTKALAGYAKWFTTLSLPGSCASYGYWTNPNDTSCYDTYNASSPLFTDLSPENTGNRQWWWFLCNEPFKWWQVRGLGNLVSRLVNQPYFERQCGLIFPREGKYTYGIAQGATTARVNRVTGGWYNVNTHRLAWTAGEYDPWRPATVMAVDRPGGPLRSTKQHPVWVVPGAAHCGDMLVRNRNANEGVRNVFDSEVANIKQWVQEFYEEKGKKGN

SEQ ID NO: 787 - protein, 507 aa, Trichoderma virens
MRPRRPELEPVRLAANAATPGHAFFEQLIDHDHPEKGTFQQRYAWNGEFYKGPGSPIILMGPNESALDGFEGYTTNKTLPGVIAQELGAGALIIEHRYWGQSSPFDTLNTENMQYLTLEQSVKDLVYFAQNVVLPFDQNRTSTPDKAPWVLAGCSYSGALTGWVQDLAPGTFWAYSCSSPVVEAVDELWRYFEQVKLAMPKNCSSDYAQVIQHVDQVLLGRNQKAKDDLKALFGLADLEHDDDFAAALNNGLYTWQSVLFSDASNPLLVMCDYVENVWPGSTSPVPGAKGVGLTKALAGYAKWFTSVSLPGSCSGYGYWSNPNDTSCYDTYNATSPLFTDLTVENTANRQWFWYLCNEPFKWWQVRGQGNLVSRLVNEPYFERQCNLFFPREGKYTYGIAKGVTTHHVNQVTGGWRNVNTHRLQWTAGEFDPWRPATVMAENRPGGPLQSTPEHPVFVVPGAAHCGDMLVRNANANAGVKKIFDAQVANVKQWVQEFYEEKGGKPHY

SEQ ID NO: 788 - protein, 533 aa, Trichoderma atroviride
MRSSNPIAVAAELLLLAGAVSAGTPQDTSPPKAPVGAGVLATGSGPTYRTFQQLIDHDHPELGTFSQRYVYNGDYYKGPGSPIILVGPNESALDGYEGYTTNATLPGTYAQAVGGGAIIIEHRYWGQSSPYQSLDTENMTYLTLDQSIKDLTYFAKNVVLPFDQNRTSTPDKAPWVLSGCSYSGALTAWVQDIAPGTFWAYSASSPVVEAIGPLWQYFEQVKLAMPQNCTSDYVKIIDHVDSILLGNDKKAKADLRSLFKLEGVEYDDDFAAALVNGLYTWQNVLFADGFSATNQMCDYVENKWPNSTSPTPGAKGVGLTKALAGYAKWFTELSLPNTCSSYGYWKGEFDVDCYNTHNASSPLFTDLTPTNSANRQWNWFLCNEPFKWWQVRGEGNLVSRLVTQAYFERQCGLFFPKEGDYTYGIAEGKTTADVNKVTGGWYNVNTHRLQWAAGEFDPWRPATVMATTRPGGQLQSTAAHPVRVIPGGAHCGDQLTFNAQANAALGTIFAAEVASIKQWVQEFYAEKGGKNHY

SEQ ID NO: 789 - protein, 526 aa, Aspergillus niger
MRSFSVVAAASLALSWASLAQAARPRLVPKPISRPASSKSAATTGEAYFEQLLDHHNPEKGTFSQRYWWSTEYWGGPGSPVVLFNPGEVSADGYEGYLTNDTLTGVYAQEIQGAVILIEHRYWGDSSPYEVLNAETLQYLTLDQSILDMTYFAETVKLQFDNSSRSNAQNAPWVMVGGSYSGALTAWTESIAPGTFWAYHATSAPVEAIYDFWQYFYPIQQGMAQNCSKDVSLVAEYVDKIGKNGTAKEQQELKELFGLGAVEHYDDFAAVLPNGPYLWQDNDFVTGYSSFFQFCDAVEGVEAGAAVTPGPEGVGLEKALANYANWFNSTILPNYCASYGYWTDEWSVACFDSYNASSPIFTDTSVGNPVDRQWEWFLCNEPFFWWQDGAPEGTSTIVPRLVSASYWQRQCPLYFPEVNGYTYGSAKGKNSATVNSWTGGWDMTRNTTRLIWTNGQYDPWRDSGVSSTFRPGGPLVSTANEPVQIIPGGFHCSDLYMEDYYANEGVRKVVDNEVKQIKEWVEEYYA

SEQ ID NO: 790 - protein, 525 aa, Aspergillus fumigatus
MRTAAASLTLAATCLFELASALMPRAPLIPAMKAKVALPSGNATFEQYIDHNNPGLGTFPQRYWYNPEFWAGPGSPVLLFTPGESDAADYDGFLTNKTIVGRFAEEIGGAVILLEHRYWGASSPYPELTTETLQYLTLEQSIADLVHFAKTVNLPFDENHSSNADNAPWVMTGGSYSGALAAWTASIAPGTFWAYHASSAPVQAIYDFWQYFVPVVEGMPKNCSKDLNRVVEYIDHVYESGDIERQQEIKEMFGLGALKHFDDFAAAITNGPWLWQDMNFVSGYSRFYKFCDAVENVTPGAKSVPGPEGVGLEKALQGYASWFNSTYLPGSCAEYKYWTDKDAVDCYDSYETNSPIYTDKAVNNTSNKQWTWFLCNEPLFYWQDGAPKDESTIVSRIVSAEYWQRQCHAYFPEVNGYTFGSANGKTAEDVNKWTKGWDLTNTTRLIWANGQFDPWRDASVSSKTRPGGPLQSTEQAPVHVIPGGFHCSDQWLVYGEANAGVQKVIDEEVAQIKAWVAEYPKYRKP

SEQ ID NO: 791 - protein, 547 aa, Neurospora crassa
MRFFSAATALLAAASTAHAAFFKTLGMEIGPIDDHIESLNKRAEVEGTSGYGTFDQLIDHNTPELGTFKQRFWYGFQYWKGPGSPIILVNPGEQAADGFNKSYLSDQRLAGWMAKDMGAAVVIMEHRYWGNSSPFDELTVKNLQYLTLENSLKDINYFAEHIDLPFDKTNGSKPANAPWIFSGGSYSGALAGWLEALYPGTFWAYHGTSGVVETLGHFWTYFVPVLEATPQNCTKDLTAVIDYVDSVLLHGTPKAKRELKSKFKLQNLTDADFASAIESGPWSWQSTQFYSEKITGYNPYYRFCDYVENVWPNSTNKVPGPLGVGIKKALDGYAKWFVEESLPGTCESSGYDAFKGEDNVLCFQNQNASNPIFHDLSVDNAYNRQWNWFLCNEPFEWWQDGAPLGRPSIVSRLVDADYWRKQCPLWFPAEKGSNATYGIKQGKRAEDVNKWTGGWKHTNGTRIMQANGSLDPWRDVTLSSKFRPGGPFKGNKNHQVRVIEGGTHCSDFYGPNWSANEGIKKVAEEEVAQMGQWVADFYKKRGITRTR

SEQ ID NO: 792 - protein, 544 aa, Myceliophthora thermophila
MRLSITALAAGLAFAPLAAAFGRGLIMDIGPDDDTVSETELQKRAETVNGWGTFDQLIDHANPSLGTFKQRYWYGTEYWKGPGSPIYLVSPGEQSGEGFNRTWLTTARLSGVMANQTGGAVIVLEHRYWGQSSPYDELTVENLRYLTLDNSLKDLVYFAKNFAPPFDPSGSSSADKAPWIFAGGSYSGALAGWLAAREPGTFWAYYSSSGVVEAIGDFWQYFVPVQEATPKNCSADVGAVINYVDLVLSFGSKKSKQALKDKFGLGELEDADFAAALEWGPWEWQSGQFYSFNTTGYNPFYRFCDYVENVWPNSTNKVPGPRGVGLTKALEGYAKYVKEQVIPGFCESAGYPEWEGENNIACFKNLDPNNAAYKDLSLDNWINRQWNWMLCNEPFEWWQDGAPLTRPTLVSRLVNADYWRKQCPLHFPEGGYGIAAGKRAKDVNRWTGGWSVTNTTRAMHTNGQYDPWRDATLSSKFRPGGPVQSTERLPVRLVKGGTHCSDLYGQNWAVNEDVKKLAQDAADEMTGWVGEWYEEKGLPKPWAA

SEQ ID NO: 793 - protein, 538 aa, Mycosphaerella graminicola
MHLLNSLAAIAVFLQHGQGLSLKQEARFETPAKAQLHARQADSTAGVVDGVFHQLVDHDNPSLGTFEQRYWYSLNYANGSNPPVVFISPLDAEAEQVKFWLHDDYVIGGMIARRIGAVMIMLEDRYFGKSSPYDQLTTENMKYYTEDQMVRDKIHFAKTAELPFAKNGGSRPDQVPWVHTGCSAQGNRVMFSQKESPDTFWASWASSAPPQAIPNYWRYFDAAKAYLPKNCTADVEKVIEHLDDVMLNGSADDIQKIKTDFGAPDLKHNDDFMNLLNYGPQTFQGASLRIGDTWQFCDYVENAVDTTDKSKLPGAEGVGLDKALKGYARWTKEVWIPGRCEQQGPWKGENNTGCFNFGDADSLVYATKGLDAPSIVDTLQAQWLFCNEPDENWQTGSPKGTPTLVSRLVNTDYFRKTCARYFPTGPNGETFGLAKGKTADIWNTRYGGWSDPIGYLNRTVLVNGKFDPWRAASFASDQRPGGILGNSTYVKHFINPMGNHCTDTYRNAGSIWPEVKAVQEAGIKQIEKWIAMFPKHKV

SEQ ID NO: 794 - protein, 548 aa, Myceliophthora thermophila
MKVSARAILPFAPWIAAKAAVIRSAPDGTPLSESAQAVVRAAGPGATCEWFTQPIDHKNASHKSWQQIYCVDPQWWTPGAPVVLMTPGGEPITWAVNSARGFSYLKNTTLAGRYAQELGAAAVVVEHRYFGGSSPYDGFDAETLQYLTLEQAAADLVNFAQNVTFPFDKEQTSVASKVPWVYWGSSYSATLGSWIEHLHPGVFHAYHLSSATVQANTENWYYYDTIRKGIDALRNDTRCSAALEEVVGFVDRFLLASPVNETQMDALKQYFGAVFPIANDDFAYAIATPFRYWEERGGYRAVLDMCDGIVGSDATEEHEVLGTIPSSVGNYAAYFQMNFRDSTCTYLDVWGQKDPLWCLDTHDPLNPFIEARTLGNPWRTRMWFPCNEPLASWATGAPRDRPSLVSRRLDAAYWQAQCEMHFPAVGDHRYGSADGLRTPDTLNAVTGGWARRSKRVIWTVGLEFDPWRATSMASELRPGGPLESSGDVYVFVIKNAAHADDALTEAGLANLNLPVNPEVVKVQQQSVGIVKEWVGQFRPGGDEEGSDE

SEQ ID NO: 795 - protein, 537 aa, Fusarium graminicola
MARGWFVNCAAVLLALTAGVDAYTVPALSARAKDSGPKAVNISVPVDHFHNETIYEPHSDKKFPLRYWFDAQYYRKGGPVIILASGETSGEDRIPFLEHGILQMLANATGGIGVILEHRYYGTSFPVPDLKPENMRFLSTEQALADTAYFAQHVEFPGMEEHNLTASTTPYIIYGGSYAGAFAAFARKIYPDLFWGGISSSGVTEAIVDYWQYFEAARLFAPGDCAKVTQKLTHAVDNILLGDDKEEKKQLKIAFGLLGLRDDDFAMTISQGIGGLQSNNWDPASDSSSFGLYCGSVSSDDILFASTRPLAPYVKKWLISAGYKKQLKYMTNRFLNYIGYIRSNVESDKSGRCDGKTLDQCYSIRGSMNDTKLDPNNMSRQWTYQTCTQWGYWQTGSGAPKDQLPMVSRLIDVEYNTIPCREEFNITTPPNVESINKLGGFNFSYPRVAFIDGEYDPWRAATPHAIGLPERESTASEPFILIPYGVHHWDENGLAPGSEEIGLPPPAVKQAQQDIIDFTKAWLEDWEKEKGGATADL

SEQ ID NO: 796 - protein, 569 aa, Aspergillus niger
MFLSLPLLGTLIASTVALDSSPLELRVPHLHQLSQLSKSHQASLNQDSASFPVYNLSVPIDHFHDESRYEPHTNATFGLRYWLDTSHYQPGGPVFVIAAGETDGSDRIPFLSQGVVTQLAAAYHGIGLILEHRYYGESYPFTNLTTENIRFLTTEQALADYAYFASNIVFPGLEDLDLTAATTPWIAYGGSYAGAFVAFLRKLYPELYWGAVSSSGVTEAIIDYWEYYEPIRLYGPSQCISTIQTSIDIVDRILIDHADNKTLAQQLKSAFGGSATNLSNQDFVSSLSYGLDSFQSRNWDKTIGTPLFRAFCNNITNSDLLYPEAAEPISASVKQLVQIAGYDPSNTTLVNNFLNWIGFLSTSKVFADSSSESSSSNITNFTTPQPLSKDSGTSWNYQVCVEWGYFTTGSSVPSTTKPLISRLLDLPYLSSFCPNTFGIKTPPDVQRINQFGGFNFSYPRVAIIGGLADPWRDATPLADGVDWQSRKSSDSEPIILLDIPAADVWDGVRGAVHHWDQNGLSGQQKKEGEKAPKEIVSVHEEVVRFVGVWLKEWKGKQSDADERVYQTVL

SEQ ID NO: 797 - protein, 561 aa, Myceliophthora thermophila
MLRGTIAVGVACLAQLVAGLDGPLFRTSLTLRDFREQLERRQARDGAALEARSSDLQDLYPAHTLQVPVDHFHNDSLYEPHSSETFPLRYWFDASHYKKGGPIIVLQSGETDGVGRLPFLQKGIVAQLARATNGLGVILEHRYYGESIPTPDFSTEKLRFLTTDQALADMAYFARHVVFKGLEHLDLTSAKNPYIAYGGSYAGAFVAFLRKLYPDVYWGAISSSGVPEAIYDYWQYYEAARIYAPHDCVVATQKLTHIVDNILLDKADTDYVRRLKTGFGLGGVTRNDDFANAISWGIGGLQGLNWDPALNDTGFGEYCNNLTATKPLYPTSPALEQEARELVKAGGYGKEADTLTTQLLNYMGYVNATTVQTCHKDSQDECFTNYNSTFYQQDDKTQDWRLWPYQYCFEWGYLQTGSGVPANQLPLISRLIDLNFTSVVCREAFNITTPSQVERINKLGGVNISYPRLAFVDGERDPWRYASPHRIGLPERKNTISEPFILIKDGVHHWDENGLFPNETRPGLPPKPVADAQRAEVKFVKAWLKEWKEKEKCRGRKFCWP

SEQ ID NO: 798 - protein, 561 aa, Neurospora crassa
MMGLGRLLAATACVAQLASALAPAFAPLSVRNLRLSSESDLALEPEGDFTIQESTDPTLLYPARTIKVPVDHFHNDTKYEPHTNDTFDLRYWFDATYYKKGGPVIVLAAGETSGVGRLQFLQKGIVYQLAKATGGVGVILEHRYYGKSLPTSDFSTKNLRFLTTDQALADTVYFAKNVKFAGLEHLDLTAPNTPYIAYGGSYAGAFVAFLRKLYPDVYWGAISSSGVTEAIYDYWQYYEAARIYGPKDCVTATQKLTHVVDNIILNKANARYVQKLKDTFGLGNLTHTDDFANTISFGIAGLQSTNWDPALNDTSYGEYCNNVSSNALLYPETARLEKDVQELLTVGGYGKEVKTLTNQFLNYIGYVNVTSVQSCDGDQNACFTSYDSEFYKKDDLKQTWRLWLYQVCDQWGFLQTGSGVPHNQLPLISRAIDLNYTSIACREAFNINKPSDVESINKYGGFGISYPRLAIIDGEKDPWRAATPHAIGLKDRKSTISEPFILIKDGVHHWDENGLFPNETAPNFPPKPVEETQRAIKNFVQAWLQDFKKSGHGHGHGSTKP

SEQ ID NO: 799 - protein, 572 aa, Aspergillus fumigatus
MQLQAVLFLIGTFLASAAQGFDISPLELQFPLLHQLRLLEDETGASLHLTSLKEFVDHNFSVPIDHFHNESRYEPHTRDHFNLRYWFDASHYKEGGPVFLIAAGETNGRDRFPFLSHGIVTQLAKTYNGLGVILEHRYYGESYPFADLTTKNIRFLSTEQAMADYAYFASNVVFPGLEHLNLTADAVPWIGYGGSYAGAFVAFLRKVYPEVFFGVVSSSGVTEAIVDYWQYYEPIRQFAPSDCIWSIETFMDIVDTILIEHAKNETLKSHLKAVFGATSSDVDDEFFAAALSSTLGAFQGRNWDPAVGDGTFQRYCKNLTSPSLLYQQNNTMKAWTEEVISATKYDATNSSLVTGMLNYAGYMNATMFSHLDEVRGTSSHKSPQSLQKSSGVSWGYQVCTEWGYFMPGSSVPKDRLPLISRLITLAGESRFCKEDFNITTPPDTDRINKHGGFNFSYPRAAIIDGLADPWRDATPHADGTRPRQSTDEEPFILVDVPAEDVWDGIRGAVHHWDQNGLSEQDVQQGKTAPKAIVALQQEIIRFVGVWLKQWRKHEDVSDPTANTAVRNRQLVL

SEQ ID NO: 800 - protein, 566 aa, Aspergillus oryzae
MVSLTHIFSKALLTLLVGQSAALSFLPGIKANNLQLASVLGIDGHTARFNPEKIAETAISRGSGSEVPARRISIPIDHEDPSMGTYQNRYWVSADFYKPGGPVFVLDAGEGNAYSVAQSYLGGSDNFFAEYLKEFNGLGLVWEHRYYGDSLPFPVNTSTPNEHFKYLTNSQALADLPYFAEKFTLNGTDLSPKSSPWIMLGGSYPGMRAAFTRNEYPDTIFASFAMSAPVEARVNMTIYFEQVYRGMVANGLGGCAKDLKAINDYIDSQLDKKGQAADAIKTLFLGKEGIHNSNGDFTAALGSIYNLFQSYGVDGGEESLSQLCSYLDKEASPNGIARKIGVKELTEKFAAWPPLLYLINQWGSQVGNGDSNCKGQNNSTETVCELGGQFTDPDTISWTWQYCTEWGYLQADNVGPHSLLSKYQSLEYQQSLCYRQFPGAKESGLLPEHPEANETNAETGGWTIRPSNVFWSAGEFDPWRTLTPLSNETFAPKGVQISTNIPKCGVETPENVLFGYVIPRAEHCFDYDLSYKPADKSRKLFSLALKKWLPCWRSEHAPKGVQRKWM

SEQ ID NO: 801 - protein, 557 aa, Penicillium chrysogenum
MHFSTVVKGIATLTALSGTAAGIVTSQFKRDLKLSAELGIHPDTLLGQKTTVHDVTNSQLDETIEAEYVSIPIDHSNSSVGHYRNRYWVSEEHYKEDGPIFVFDVGESTAEPAGQTYLSNSSTFFYQLVKEFGGIGIVWEHRYYGDSLPYNVSLDMEPEHLQYLNNKQALADIPYFAAQFTRQDYSDVDLTPAGTPWVMVGGSYAGMRAAFTRQSYPDTIYAAFASSAPVEARIDMSVYFDQVYDGMVTYGHLNCTRDIKAALEYIDEQLSKSESAAAAIKREFFGEGAEKNSNGDFTAALVTIYNFFQSYGMGGGVGSLESFCEHMETDPKTSAAAPSEGFAPTRGKKYVAERYASWPVFTQVVNMNMKTNCKKLETSEPLECDLGPPSANPDTISWTWQYCTEWGYFQTNNFGAHSLLSKYQTLEYAQEYCNRFFPEAVAKGLFPKHPQTEATNAETGGWSIRPSNVYWSGGQFDPWRTLSPLAETRLGPQGVTLTTEIPKCNVETEENTIFGYIMQKAEHCFDFHTAFVPGAISRGYFQTALKEWLGCFKAKTR

SEQ ID NO: 802 - protein, 573 aa, Aspergillus oryzae
MHSSLKLLLSAASLLPLAQAFQYTPLQLAYPELRAKQQLTPESAVKQQSTTAEYPEYYLSVPVDHFHNDSRYAPHSDDHFDLRYWFDAQYYKEGGPVFVIAAGETDATDRFPFLSQGIVTELASAYNGIGVILEHRYYGKSYPVANLTTENIRFLSTDQALADYAYFASNVVFPGLEHVNLTSKTTPWIAYGGSYAGAFVAFLRKLYPDVYWGAVSSSGVTEAIIDFWQYYEPIRKFGPSDCIWSTQTFIDVVDRILIDHADNKTLGQQLKTSLGVSPDKDDVSFVSLLSSGLDSFQSRNWDSNIGSYSFRSYCDNITSSDLLYPDTEAVKPTIQELIEVAGYDATNSSFVNGFLNHVGLFKKSITSDEDSAETEQSDSSDPKSLPKDDGTSWEYQVCTEWGYFMSGASVPKDIMPLISRVLDVASVSTFCETTYGITSPPNVTNINKHGGFNFSYPRVAIIDGLADPWRDATPHADGTKERESTDDEPFILIDVPAEDVWDGIRGAVHHWDQNGLSKTDEGKGQEPPAAIVEVQKEVLRFIGVWLDQWKKRSRDSSRPLGGIRGPGRSQVPL

SEQ ID NO: 803 - protein, 557 aa, Aspergillus nidulans
MRFNPLISTAFVASLASFASGLGLRSDLAKSLQLAAELGLDSDLLLKDSQSFRTAVTQTNPPAEYVLVDSRFLMTMCTGSNALQLPIDHHNPAIGTFRNRYWVNDAYYVPGGPVVLYDVGEADGEPSVAHLRSNSSFLPPILQEFGAIGIVWEHRSVVSTKVETRIEIDRNRYYGDSLPYPVNNNTLPEHLIYLTTRQALADIPAFAENFTRPGLQEYDLTPASTPWVMIGGSYPGARAAFARNEYPDTIFASFAASAPVQAQINMSIYYEQVYRSMVANGFRSCASNIHAALEYIDNQLSQNDTAASIKQLFFGPGAEKNSNEDFTHALAVIYGSFQAYGMDGPAGSLGEFCRYLESDPVTGQPAETEGLALRHGYKHLAERWAEWPIFTQLINVNYETNCKGLDKSVAPSCELNKPTTNPTAIAWTWQYCTEWGFYQSNNEGVHSLLSRYQTLEFQQVMCNRQFPEAVKNGLLPPQPRVDALNAEFGGWNIRPSNVYFSAGEFDPWRTLTLLSGEQFSLQLNVTSDVPRCGVRTGPDTVFGWAPCGRMSSQHSIL

SEQ ID NO: 804 - protein, 562 aa, Aspergillus niger
MPSYSATIAAIGAFLLSQPVMGSRQGKAPFGWGTQSLAHFGINPDLGLHNQQNLNSLISHSAMATALETEYATIPIDHNNASAGTYQNRFWVSDEFYQPGNPIFVYDTGESDGGSIAQSYLTSTLSFFREFLIEFNAMGIAWEHRYYGNSTPAPVSYETPPEAWQYLTTKQALADLPYFASNFSREKYPDMDLTPQGTPWIMVGGSYAGIRAALTRKEYPETIFAAFSSSSPVEAQVNMSAYYDQVYRGMVASGWTNCSADIHAALEYIDDQLSDEDTATSVKQLFFGSGAETNSNGDFTAALTAIYGYFQSYGMAGGIGGLGAFCEYLEIDPKTNGTTGPDGLAPTYGGQYVAERWAAWPTFLELVNLNMGTNCGPQDASQPIDCDFSKPYGDPSAITWTWQYCSEWGFFQANNDGPHSLASRYQSVEYQQEVCNRQFPDAVDKGLLPPSPRADDVNQEFGGWTIRPSNVYFSGGEFDPWRSLSILSTEDFAPQGVEFTSAIPACGVQTNEDTVFGYVMQNSEHCFDFQATPTVGKLSRGIFTSALLQWLECFGQNSSQSR

SEQ ID NO: 805 - protein, 541 aa, Aspergillus oryzae
MVSLTHIFSKALLTLLVGQSAALSFLPGIKANNLQLASVLGIDGHTARFNPEKIAETAISRGSGSEVPARRISIPIDHEDPSMGTYQNRYWVSADFYKPGGPVFVLDAGEGNAYSVAQSYLGGSDNFFAEYLKEFNGLGLVWEHRQALADLPYFAEKFTLNGTDLSPKSSPWIMLGGSYPGMRAAFTRNEYPDTIFASFAMSAPVEARVNMTIYFEQVYRGMVANGLGGCAKDLKAINDYIDSQLDKKGQAADAIKTLFLGKEGIHNSNGDFTAALGSIYNLFQSYGVDGGEESLSQLCSYLDKGASPNGIARKIGVKELTEKFAAWPPLLYLINQWGSQVGNGDSNCKGQNNSTETVCELGGQFTDPDTISWTWQYCTEWGYLQADNVGPHSLLSKYQSLEYQQSLCYRQFPGAKESGLLPEHPEANETNAETGGWTIRPSNVFWSAGEFDPWRTLTPLSNETFAPKGVQISTNIPKCGVETPENVLFGYVIPRAEHCFDYDLSYKPADKSRKLFSLALKKWLPCWRSEHAPKGVQRKWI

SEQ ID NO: 806 - DNA, 57 bp, Artificial
  Primer
gtaacgccagggttttcccagtcacgacggtttaaaccatggaagatgcgagctaca

SEQ ID NO: 807 - DNA, 68 bp, Artificial
  Primer
gcgctggcaacgagagcagagcagcagtagtcgatgctaggcggccgcggagaggagatgggtgttga

SEQ ID NO: 808 - DNA, 68 bp, Artificial
  Primer
cccccctttctctctctctttcaacacccatctcctctccggcgcgccgcgaggtgcgtttctgtagc

SEQ ID NO: 809 - DNA, 57 bp, Artificial
  Primer
gcggataacaatttcacacaggaaacagcgtttaaaccggcaaatactacgacgaca

SEQ ID NO: 810 - DNA, 68 bp, Artificial
  Primer
gtacacttgtttagaggtaatccttctttctagaaggagagcggccgcgtcgagtgcatcaatgacga

SEQ ID NO: 811 - DNA, 68 bp, Artificial
  Primer
caaacagcatgctcgtaaatgctacagaaacgcacctcgcggcgcgccggagaggagatgggtgttga

SEQ ID NO: 812 - DNA, 57 bp, Artificial
  Primer
gtaacgccagggttttcccagtcacgacggtttaaacccattctcgtcgttgtttcc

SEQ ID NO: 813 - DNA, 68 bp, Artificial
  Primer
gcgctggcaacgagagcagagcagcagtagtcgatgctaggcggccgctggaggagtagctgcactga

SEQ ID NO: 814 - DNA, 68 bp, Artificial
  Primer
caaccagccgcagcctcagcctctctcagcctcatcagccgcggccgcacagccagtggaaaccaaac

SEQ ID NO: 815 - DNA, 57 bp, Artificial
  Primer
gcggataacaatttcacacaggaaacagcgtttaaactagagcttggagggaacagg

SEQ ID NO: 816 - DNA, 68 bp, Artificial
  Primer
gtacacttgtttagaggtaatccttctttctagaaggagagcggccgcgagtcggtcctactgcttga

SEQ ID NO: 817 - DNA, 68 bp, Artificial
  Primer
ttttacttgttttgataagggtttggtttccactggctgtggcgcgcctggaggagtagctgcactga

SEQ ID NO: 818 - DNA, 20 bp, Artificial
  Primer
acagccagtggaaaccaaac

SEQ ID NO: 819 - DNA, 58 bp, Artificial
  Primer
ggtaacgccagggttttcccagtcacgacggtttaaacatgggctgaaaccggcgcaa

SEQ ID NO: 820 - DNA, 68 bp, Artificial
  Primer
gcgctggcaacgagagcagagcagcagtagtcgatgctaggcggccgcgacagcgcctcgccaagtgt

SEQ ID NO: 821 - DNA, 68 bp, Artificial
  Primer
gtacacttgtttagaggtaatccttctttctagaaggagagcggccgcagcagcctgcccagagaatc

SEQ ID NO: 822 - DNA, 68 bp, Artificial
  Primer
gtcattaagtccatcattccacgtccttcagaccgaattcggcgcgccgacagcgcctcgccaagtgt

SEQ ID NO: 823 - DNA, 68 bp, Artificial
  Primer
atgatgcctttgcagaaatggcttgctcgctgactgatacggcgcgcctggcgcttccgttcccttcc

SEQ ID NO: 824 - DNA, 58 bp, Artificial
  Primer
agcggataacaatttcacacaggaaacagcgtttaaactgttgagacgggcgagtgct

SEQ ID NO: 825 - DNA, 68 bp, Artificial
  Primer
tgattgtaccccagctgcgattgatgtgtatctttgcatggcggccgcagcagcctgcccagagaatc

SEQ ID NO: 826 - DNA, 68 bp, Artificial
  Primer
gacaatcagaggcctcaattggaagggaacggaagcgccaggcgcgccgacagcgcctcgccaagtgt

SEQ ID NO: 827 - DNA, 20 bp, Artificial
  Primer
tggcgcttccgttcccttcc

SEQ ID NO: 828 - DNA, 57 bp, Artificial
  Primer
gtaacgccagggttttcccagtcacgacggtttaaacaaccacgacgaaaatcaagg

SEQ ID NO: 829 - DNA, 68 bp, Artificial
  Primer
gcgctggcaacgagagcagagcagcagtagtcgatgctaggcggccgcaatggacccagatgtcaagg

SEQ ID NO: 830 - DNA, 68 bp, Artificial
  Primer
caaccagccgcagcctcagcctctctcagcctcatcagccgcggccgcgatctaggattcgccaaacg

SEQ ID NO: 831 - DNA, 57 bp, Artificial
  Primer
gcggataacaatttcacacaggaaacagcgtttaaacacgacatgaacaaacggaca

SEQ ID NO: 832 - DNA, 68 bp, Artificial
  Primer
taatctctaatcacctaataccttgacatctgggtccattggccggccgatctaggattcgccaaacg

SEQ ID NO: 833 - DNA, 68 bp, Artificial
  Primer
gcgctggcaacgagagcagagcagcagtagtcgatgctaggcggccgcagtatcgcaggagcgagcat

SEQ ID NO: 834 - DNA, 20 bp, Artificial
  Primer
ccgtctagcgctgttgattg

SEQ ID NO: 835 - DNA, 58 bp, Artificial
  Primer
gctggatgaacgtttggcgaatcctagatcgcggccgcgtgctgcggaatcattatca

SEQ ID NO: 836 - DNA, 68 bp, Artificial
  Primer
gtacacttgtttagaggtaatccttctttctagaaggagagcggccgcggggaaacaatgacatacgc

SEQ ID NO: 837 - DNA, 68 bp, Artificial
  Primer
ctcttggagagtcttctccaaaacccaagcttatcacccaggcgcgcctttgcagcaagatgtcgttc

SEQ ID NO: 838 - DNA, 20 bp, Artificial
  Primer
tgggtgataagcttgggttt

SEQ ID NO: 839 - DNA, 68 bp, Artificial
  Primer
tcttcttgacacaatgttcctgttctcctcatccttggatggccggccacctaatggtttcttcgttt

SEQ ID NO: 840 - DNA, 68 bp, Artificial
  Primer
gcgctggcaacgagagcagagcagcagtagtcgatgctaggcggccgcctggagaggatatggttctg

SEQ ID NO: 841 - DNA, 58 bp, Artificial
  Primer
caccaaagaaaaacgaagaaaccattaggtgcggccgcgtgctgcggaatcattatca

SEQ ID NO: 842 - DNA, 20 bp, Artificial
  Primer
aaccaccttgttctgtccgt

SEQ ID NO: 843 - DNA, 20 bp, Artificial
  Primer
ggaactgtcaagatctggga

SEQ ID NO: 844 - DNA, 20 bp, Artificial
  Primer
cttctgcaaggaggacgatt

SEQ ID NO: 845 - DNA, 18 bp, Artificial
  Primer
gcgatgccgtacgtgtac

SEQ ID NO: 846 - DNA, 19 bp, Artificial
  Primer
taggtctcggctgacaagg

SEQ ID NO: 847 - DNA, 20 bp, Artificial
  Primer
gcttcttccactgaatgctc

SEQ ID NO: 848 - DNA, 20 bp, Artificial
  Primer
catcaccaagaaggtccctc

SEQ ID NO: 849 - DNA, 20 bp, Artificial
  Primer
actcaatggaaccacatcga

SEQ ID NO: 850 - DNA, 19 bp, Artificial
  Primer
ctgtggttgagtgcagatg

SEQ ID NO: 851 - DNA, 20 bp, Artificial
  Primer
tcccacacatcaacacaagt

SEQ ID NO: 852 - DNA, 21 bp, Artificial
  Primer
ctccatattctccgatgatgc

SEQ ID NO: 853 - DNA, 20 bp, Artificial
  Primer
tgaatttgttggatccctgc

SEQ ID NO: 854 - DNA, 20 bp, Artificial
  Primer
tacccaggtcaaaagagcag

SEQ ID NO: 855 - DNA, 19 bp, Artificial
  Primer
gcctgaactcaccgcgacg

SEQ ID NO: 856 - DNA, 20 bp, Artificial
  Primer
cctttgccctcggacgagtg

SEQ ID NO: 857 - DNA, 20 bp, Artificial
  Primer
ccactgaaggggagttttca

SEQ ID NO: 858 - DNA, 20 bp, Artificial
  Primer
tcgcggtatcgtatgagatg

SEQ ID NO: 859 - DNA, 20 bp, Artificial
  Primer
gccagcttcaacatcgactt

SEQ ID NO: 860 - DNA, 20 bp, Artificial
  Primer
cagcacgagcacgttgtact

SEQ ID NO: 861 - DNA, 20 bp, Artificial
  Primer
aagtgtgctgatgtgatgga

SEQ ID NO: 862 - DNA, 20 bp, Artificial
  Primer
gcatgcgaagtaccttacga

SEQ ID NO: 863 - DNA, 20 bp, Artificial
  Primer
agttaatgatgcccgtcttg

SEQ ID NO: 864 - DNA, 20 bp, Artificial
  Primer
gagcgtctcctgttagcttg

SEQ ID NO: 865 - DNA, 20 bp, Artificial
  Primer
gggttggagatgttggaaga

SEQ ID NO: 866 - DNA, 20 bp, Artificial
  Primer
ttgacgagacggggagttac

SEQ ID NO: 867 - DNA, 20 bp, Artificial
  Primer
cagccctgacaccactctct

SEQ ID NO: 868 - DNA, 20 bp, Artificial
  Primer
tccagtccttgggagaaatg

SEQ ID NO: 869 - DNA, 22 bp, Artificial
  Primer
tggcattgatctagaacctcct

SEQ ID NO: 870 - DNA, 20 bp, Artificial
  Primer
gacgacttggtggagctcat

SEQ ID NO: 871 - DNA, 20 bp, Artificial
  Primer
gactacccccagaacgtcaa

SEQ ID NO: 872 - DNA, 20 bp, Artificial
  Primer
aagaggcggatcttttggtt

SEQ ID NO: 873 - DNA, 20 bp, Artificial
  Primer
gcctccgccctcctcttcca

SEQ ID NO: 874 - DNA, 20 bp, Artificial
  Primer
gctttgtcgagcggagcggt

SEQ ID NO: 875 - protein, 471 aa, trichoderma reesei
MASRRLALNLSQGLRARSGLSGLRRGFATPSTVGKTQTTTLKNGLTVATEYSPWAQTSTVGMWIDAGSRAETNETNGTAHFLEHLAFKGTAKRSQHQLELEIENMGGHLNAYTSRENTVYFAKAFNSDIPQTVDILADILQNSKLEQSAIERERDVILRESEEVEKQVEEVVFDHLHATAFQHQPLGRTILGPRQNIRDITRTELVNYIKNNYTADRMVLAAAGGVPHEQLVELAEKHFSGLASHGPETEAYVLSKQKADFIGSDVRVRDDTMPTANVAIAVEGVSWNSDDYYTALVAQAIVGNYDKAMGNAPHQGGKLSGYVHKHDLANSFMSFSTSYSDTGLWGIYLVTDNATRLDDLVHFAIREWMRLCYNVSEAEVERAKAQLKASILLSLDGTTAVAEDIGRQLITTGRRASPGEIERKIDAITDKDVTDFANRYLWDKDIAISAVGKIEALFDYQRLRNTMKPKF

SEQ ID NO: 876 - protein, 462 aa, Trichoderma reesei
MAFWVVGGGNPLGDAASSSRGQVAAYIKGEALGSNGKRRIFADGSASACSEAGCYGITKRPRLDDWGRVIGFHGKGHHAAGCEHERSGLVSPAAAAAEAEAASIHVKNLAFLVIREREPSPPATPPPQKGLSPDLRPGFHGLAPSYAPAPMERTQSGLSISSDTSAVDARDSDLEPLLSDLAAARLVRRHVANNCRWKHRDSQHGRILKALINPKSREADFPLDNDALRSIFSAANELFFANKLTQRVTWDWSHPASAQYESHIVGTTALRRSVRLGGYETLIVLSSPILKDTKYNRRLLISTFLHEMIHSFLFITCGIKARYQGGHTEGFRQIAEIIDDWVGAEHLRLRDMEADLERFIDDDGPPSTAIRASIEGGFSHSNHYYYGSNGNGNGNGNNHIHHSHSHNPRTTWPISEWQHAENHDYRLIEAPQPYTRYPSNYDEWEWHDREGFPAQTAHLYHH

SEQ ID NO: 877 - protein, 884 aa, Trichoderma reesei
MADRDVLPDNIKPSHYVLSLRDLDFKAWTYKGTVTIQSEVVKPTKELVVNALELKLLNAKVTLDHTKSEQSWQSSNVSYDAKAQRATVAFDAEIPVASKASVVIEFEGIINNEMAGFYRSKYKPAATPAASVPRDDEWHYMLSTQFESCDARRAFPCFDEPNLKATYDFEIEIPVDQVALSNMPVKETKPTKEGWHLVSFETSPLMSSYLLAWAVGDFEYIEQLTDRKYNGKQIPVRVYTTRGLKEQGRWALEHAPKIIDYFSEIFDIDYPLPKSDLLAVHEFTHGAMENWGLVTYRTTQVLFDEKTSDARFKNAVAYVVAHELAHQWFGNLVTMDWWDELWLNEGFATWVGWHAVDHLHPDWQVWAQFVSEGMENAFRLDGIRASHPIHVPVRDALDVNQIFDHISYLKGCSAIRMLANHLGVETFLKGVSNYLKAHAYGNAKTKALWDALAEASGKDINQIMHPWISKIGHPVLTVSEEPGKLAIKQSRFLSTGDVKPEDDTTTWWVPLGLAGKKGEPGVSALSLTKKEDIIDDIDTDFYKLNSGATGFYRVAYPPARLAKLSSQLDKLSTEDKIAIIGSTADLAFAGNSSASALLTFLQGFQKEEHPLVWSQILGCIGDLKSVFGEDKEIKKGLNNFAVKLMDEKVKQVGWEFPEGENYLGGILRKDLIAAAVAADHPEVKAEAIKRFNAWVENPEANAIHPSLRGAVWRAGLDDNAAKNVEVLKKEWFTTKSIDGKLIALAALSTVDDADIVKNNLIPFNFNTAPPHNAVPAADMHVLGGNLAAHPVGRTLQWEFLKSNWELAVAKLGNPIVVDRFIGLSLKTFTDAAVLDDIEQFFKDKDTHSFDRTLETAKDRIRGRAAYKKRDSEALKQWLSENGYF

SEQ ID NO: 878 - protein, 714 aa, Trichoderma reesei
AHSLKRSPLDYVSVIDNVKIHTPSGRVHAHSAFDLTFSIHDGEDKFRLSLHPNHDILHDDLEVTYLDSEGKVKSVEKVERGEHKVYRGDAYVERPGEDGWSLGGWARITMHRDGKHPVFDGSFRIDGDDHHIHTGSKYINIKHEDDPLPSDWPEKDHDEVMVVWRDSDVRGSLDRGELKRDVSKPSECISDSLTFNNQFDLELKRSTGLRGIDPRSLFGRQSIDGGSNGGGSGQDLISSIGQTAGCPTTKKVALVGIATDCTYWNGFNSSEELRKNVIGMVNQASQVYESAFKISLGIRNLTVLDRGCPGAPSAATPWNVGCSDNTTISDRLNLFSAWRGRSLDSNAYWSLLTTCPTDAAVGLAWRSQVCRQGSGTSSDGQGNNETVAGANVVVRTSTEWQVFAHESGHTFGAVHDCTSSTCPVDPSSQACCPLSAGSCDAGGRFIMNPSTGTGITQFSACSVGNICSSLKAAALSSCLTDNKNVPTITGSQCGNGIVEEGEECDCGGTQGCGNNTCCDARTCKFKNNAVCDPSNEDCCNDQCQFASSSTVCRPSTGECDVQETCPGDAARCPDDQHKSDGDGCGSGDGLRCASGQCTSRDRQCQVAVGTSADNSSTTACPDTRDSCTVSCYTGQSAFGQRQCLLFGQNFIDGTPCGSGGHCSNGECEGTSTAGEIRDWITSHKEIVIPIAVVVGVLLIIVVVSGIISCCRRAR

SEQ ID NO: 879 - protein, 1025 aa, Trichoderma reesei
MERVPAPVKAEAQGPSRPSSVVLLTDKLEKPSIDEREYRVIRLENGLEALLAHDPEADKASAALDVNVGNYSDEAEMPGMAHAVEHLLFMGTKKFPIENEYSQYLSANSGHSNAYTASTSTNYYFEVAAKPANGQNPSDANPSPLRGALDRFAQFFIEPLFLSSTLDRELQAVDSENKKNLQNDTWRIHQLAKSLSNPKHPFCHFSTGNLEVLKTIPESKGINVRDKFIEFHAKHYSANRMKLVILGREPLDVLQKWTVEFFSDIVNKNLPPNRWTEEPPFRESDIGVQFFAKPVMDTRELHLFFPFLDEEHLYETQPGRYCSHLIGHEGPGSIMSYIKNKGWANGLSAGASPICPGTPGVFEVQIRLTEEGLKVYPQIVNVFFQYIALLRETPPQEWIFQEQKIMADIEFKYREKAPASRFTSRVSSVMQKPLPREWLLSGYSLMRTFDADLIQQALAKFRPDNLRLCVVSQTYPGTWDKKEKWYGTEYRYERIPKDQMEDWKRAMETPSQSRLSELHLPHKNAFIPNRLEVEKKEVSEPALAPRILRNDEAARTWWKKDDTFWVPKANVIVVLNIPLVNASSQSYVKAKLFTELVRDALEEYSYDATLAGLEYTVSLDIRGLCIEVSGYNDKLPVLLEQVTATLRDLPIKDDRFTVVKERVTRNYDNWQLHSAYQQSGDYTSWLNAEHDSLVEELAVELREVTVDDVREFQRQLLAQMHIEVYAHGNMNKGDALRATDTVLSALKPRVLPKSQWPIIRSLILPPGSNFVYKKTLKDPANVNHCVETCLYIGEKGDRQTRAKTLLLDQMIHEPAFDQLRTKEQLGYIVFTNMRPFVTTYGFRIMIQSDRTPDYLDKRIEAFLVLFGEMLKNMTEDDFEGHKRSLINKRLEKLRNLDQETNRHWAQISSEYYDFEQAHQDAAHVKPITKADMISFFDKYFSPFSSSRARLSVHLCARGSDERDSKELGLPQTAPELLETPSNIASAVDSAVEITDGRLYKAGLRASSGARPVKDIAEFEETDPKL

SEQ ID NO: 880 - protein, 430 aa, Trichoderma reesei
MHSRLLITALFLGLIALVSASAIPIHQKRGSFKVERRANPNFTGNDGLKAMAKAYRKFGWTMPQDLKDALAVREAAVKARRAAAAAGGNQTQPAPAAQPASGQVGSVTNTPEGNDVEFLSPVKIGGQTLNLDFDTGSSDLWVFNTAMDPSLTAGHTLYDPTKSKTFKQIQGAQFLVQYGDGSGAEGVVGTDVVDVGGAVFDAQAVEIATAVTQQFVDDQQNDGLMGLAFSKLNTVQPQQQKTFLDNVQSSLAEPVFTADLKKGQPGTYTFGAVDASAFQGDLTWVDVDNSQGFWQFSSESFAVDGGATQQATAGGQAIADTGTTLLLADPIIVQGYYAKVQGAQNDAQAGGFTVPCDAQLPDLDLDVGGKYVARISGSDLNFAPVQGNTCFGGLQATTQGGLGVYGDIFFKSQFVAFNIGNNTLGLAPHA

SEQ ID NO: 881 - protein, 849 aa, Trichoderma reesei
MRRDVLAIAAVAGLVYANDPAPVAFDAGEWLGIDGNWSTIKVLLGSNSDLVNVLMSTSLSEFWAVGPGGCLKKEPHCTAARGGIYTPFASKHWSYMGIWQLGLEYLGYGGNGQYGLDTVNAYSKITDIGFGMSNVLMSAINTTDYYLGYFGLGITQGNFGREVAQSPLTQAVHTFGWIPSYSYGFTAGASYRNTPVSITLGGHDTARYVPHDIDFTLTPQDNMPRALIRGIEASAKKANKPKKWASETASLSGWDNSFTALIDSTTPYLWLPSAVCDRFADAFNLTYNATFDLYTLTNEQFNQYGSADSFTFTFSFSSFDNNDNFGSPLNVPGLVNITVPMRAFVGLLQYPFMHRTIKYGDPAVPYFALRKSHNDSAIVIGRSFLQEAYIITKYDEAVFSIHQAKFPEQPVAEANLVPIKQPNNSPYPSPPKQTGNRLSTGQMVGIVVGGILLCSFCLIILCCVCRRRKSPEKGDDATITETKDGASTLIPDTPRIPRPTLFLKFTRRKRFESEASKVTSPVSPLCIEAPDSEIYELPAPMPPVELDASDGEDVSSILIGETVLGTETTGSLSAYEMARRKMDRQLQGPVPEYSPPLLDTALPQEKAMAEASGVRATSGREAVPVSPIKAESGTGSLPASLPSPISSGYDSHPDTMPYPGAGFAAAQDSSGSSRSPYEQAAKAHFQLVNSRSNSRRSMSPAASNLDQNSDSPVACQKTPIDPTNIVCLGNLPDNLKTLRHSIMLAHIVSQENRDSFDSFTPRFKAEFHLSEQSLGSNYTEEEDRMMQEMTMQEMTMQAASSLGQSHEDSPSDGLSRDRRETYNSTQEMKNGNDIVHVPQLAEKRYSWED

SEQ ID NO: 882 - protein, 451 aa, Trichoderma reesei
MRPPTSLSAALTLLLATDYIEAIATPVFPRAKSGDGYLAIPVGTIPRPRKVGKRSAIDATLQNMDFFYAIQVGMGTPPQNVTVLVDTGSSELWVNPDCSTAPSQQQADMCENLGQYNPRRSRTPPVGPFGREEINYGDPTDQSTQTSVDITYYADTLSFGSIQVKNQTFGVVTASDGQAQGIMGLAPDVRGGFPGDEPYSLLLNTMAEQGVIASRVFALDLRHSDSETGAIIYGGLDRSKFVGSLEARPIVRGIKGETRLAVNLTTLGLTLGRSQSFRLSAADTNVMLDSGTTLSRMHEAAAIPILEALGAQDAGEGYFYVPCSTRNAGGSVDFGFGNKVVRVPFSDFILTGEDSSDSDYCFVGIVITTDQQILGDTVLRAGYFVFDWDNREVHIAQAADCGSSDIVVVGRGSDAVPSVQGNCNENEAFPTGSGSPTVSISFVQTAFTAND

SEQ ID NO: 883 - protein, 646 aa, Trichoderma reesei
MPARLHRLWVVTLIPFASALGLGRRDTDSLPSPVSVSPSQFFEGIDGPWSTFELRVGTPAQNLRVLPGTSSTQTVVVLPEGCQIIKVTDCANSRGGLFNTTASKTWDDIGLYGLGIENSLGYSDNGEFGHDTVGLGYLGSGGPVVNHSVIAGVAGTEFYLGMLGLNPRPTNFTSQNDPQQSFMQLLKNESAIPSLSYSYNAGAPYRLNKALGSLILGGYDTSAYQDTNSSYKFFSDQSRDLTIGVQSISTNASAEDTILQSSLISMFIDSSVADIWLPVDACQAFEKAFGLKYNSTLEMYLVSDSLHKSLVDSNPSVTFTIATAITGGSTFNITFPYASFDLTLNPPLVKKTSRYFPLRRAANETQYILGRTFLQEAYLIVDYERGNFSVHPRVWNASAESNIVTILPPGVKESVPNVGSSHSLSGGAIAGIVIGVCVVIAAVALAALRYLVVTRRKKKTTASDEVEITAMSAPDAVSTTTPKPEAAETDAGVRELEGDGSAKPTPEVEGRSLATRSPMSELESSNTPVAELAAPAPLAELLSNEIYEMPGSEVPELQGSRVAPPLVLTDSESSDFSFEVEPGVIGVIQQTEEDRRLNTAESQGSQARESRPNTGERRGDAAESTLQSWVAGDDRHIQGEPHTRNT

SEQ ID NO: 884 - protein, 427 aa, Trichoderma reesei
MNGLSFERAKALREPSADRATMHFSRLRGIKGRPGQQQGQQQHHHRSAVSALSRVRSSSSSSTSSGGFKQSFQNVSAVTDASTQYAIQCGWDGVPVWLLVDTGSSDTWATQTGFECADLGGDAHSEAACGFSRPLIDGFGGGQIDDLHFFLKYGSGERISGPMGYSDLSCGGVAVARQQVGLANSTYWHGNNVTVGILGLAYPAITSAYYGDVGSEAPWNAMSYTPFLTSAISQGAIEPLFSVALVRNSTDGVIAWGGLPPMDWQFHGFAKTDLIVANLIGSPETAWKHSFYTIVPDGMKWDQTTDTTKYPYIVDTGTTMLYLPPPLAEAIANAFQPRAVYLYQWGTYFVECTAIPPHFAILIEGVEFWINPADLIYRDLVDPLTGYCAVGVASGGPGPYILGDVFLQNVVAVFDVGAAEMRFYGRK

SEQ ID NO: 885 - protein, 839 aa, Trichoderma reesei
MNLSYSLFRGASIQLDAIDLDLHHASTKIASLASVKNVWPVRYFEHLANGKGSSGNSNIGKLNHLSKHFARTTADNDTVGYAPHVLTQVDKLHAEGFTGKGIRVGLVDSGVDYNHPVLGGCFGEGCIISYGKDLIGDDFNGTNTPVPDPYPQDCLGHGTHVSGIIAAQENYLGFIGAAYGANLGMYKALNCAGVSSNDVLIAAFNEAYEDGSDIISLSVGIISGWKEDPLAIAVSRIIDAGVPCVIANGNNGPFVFSSATPADGKGVMAVASIENTMTPLLGTEGFTSLDSSSENLTSFVWIPGTPAFPNITLPLWVVTPNTTAYGTWNACSPLNENAPADLSDKLVLVELSDCSDPDIANSLLKNNAKYIMFYSSDDDLSNLYSVSTTPETLGSGMVPRQQALVWRDLLGDGTEVYATMIEPQSAGTAAAFFPNDSNGGCVDEFSSWGPTWEADLNPRISTPGGSILSTYPLWMGGYYVDSGTSMAAPLMASIYALIMEARSIKDPKTLMGLVSSTANQRKYVDYNTGIFYEGLAPVAQQGAGLAQAYDAVHATTTLSVSSISLNDTNHLVNSTDFTITNGAKQAVTYSVGHVPTLSREAYKTGQSTLGRSTTPSNATATLTFSETKVTVPAGGSAKITIEVTPPQGLNSSNLPVYGGYITLSGSNGENLVLPYLGVAGSLKNARSIDPGYSFIYHTTGRFPQEAPDNDTWTIPYPTVGSKPSTSSTIDYPALGVEADAGIPLLRADIIPLGATPAKTTNILGVDVAGSLHGYPVRWLNTNINQVAFNGVTQEGTILPEGNYAVLLRALKIFGDEENPGDYFTKQTGSFNIKYASSTT

SEQ ID NO: 886 - protein, 872 aa, Trichoderma reesei
IPGAYIVEFEDGHEEASLFSDLRRHGLAATKRLNLNYTLFKGASFQLDAVDLDPHSTSVRIATVPSVKQVWPVQRYKRPANTTLSSTSSDPDHLPNVSNLQRRAASENDTYAVHAQVQVDKLHAEGITGKGIRISIIDTGVDFNHPALGGCFGKGCVVSYGRDMVGDDYDGSNTPVPGPEPLSTCDGHGTHVTGIIGALPNPMGFIGAAPDATIGMYRVFGCSGDVGADVAISAVNQAFEDGTDIITLSLGGASGWTEDPFSVAVSRIVSAGVVCTVANGNSGSAGLFLAGTPANGKGVTAVSSVESTLTPYLGTGAFVSTDNSTANQTLFVYTPGAFPFPNNITLQVWPVTPEVTTDGTYGACNPLSNKAPADLSDKVILVKYDSACSSWTEVSNLQKNNATYFMFWYNISDPTDSPWSIGATSASGLGMTGYSQGVQWLNELSSGKDLWLTFVESSSSTKAGVFVPNAINPNYIDTFTSWGPTWQADVNPSISTPGGTILSTWPLPSGGYYIDTGTSMATPVMAAIYALVMQARGIRDPKALLNLVSSTALQLPFYDGATLYPTELASVAQQGAGLAQAFKAAHTTTLLNVPNIAFNDTDNFVKKTSFTIHNTGKQSVTYSIGQTPALTMYTYGDGDSHFPAPFPNPIAEGASAKLSFSHNKITVAAGKSADITVTATPPKGLNASALPVYSGYVTVNGTNGDGLVVPYLGVVGSLAKLPVLDPDFNYMIHYNVYSTVPAAENTTYVVPYPISTAAQPIDPPPDYPAPIIQIDAGTPLLRADLIALGDTAGKVNTTKVLGVDIVGSLPGFPLPFTSRSYFVTAFTGMTQEGIIVPEGSYKFLIRAAKIYGDVSNPDDYESMLTQTFNIRY

SEQ ID NO: 887 - protein, 705 aa, Trichoderma reesei
MTRQFSSPASANSTYFRQFDCGDIFNGVVVETDIDNVDTLSRVHGVANVWPMKTVPMASGIRRVKAALDFKSHNYSVHQWTGVDQLHTQGIRGKGATIAIIDTGIDYTHRALGGCFGPGCKIAGGYDLVGNSHNEKRFPKDPDQDPMDFHGHGTHVAGIIAAENEWLIGVAPDARLLSFKVFADDPWDTDEDVLIQAFCDAYGAGADVITASIGRPDGFADDPWALVASRIADKGVVVTISAGNEGNTGPFYSSSGANGHNVLSIAAINVTGDPSISTSDPTAAPIPAIFTSWGPTNELLLKPDVGAPGFDIISTVLDNDYDLMSGTSMAAPYIAGIAALYISKHGGREFHGPGFAKMLANRIVSSGVSLGWAADNINFEFRAPPFQVGTGLVNALKVLDYTTQLYFEPFSLSDSIQFRPKWTANITNAGNRTAVYSFEIEPQAGVEILDPHYGIKTAYNLEPMHIVPPVKLPEDVALAPGETREVEFFFGLPQTVNDDYLPLFGGKVWIRGSNGEDLSIPYGGAAYDTEKAFDTMFLGDPFITDWGGNWTSWSFNADRNRFDFMELSARLDYPCFHLRWDIYTAYWTEPHWEYPPIVGVSGYVGAAATMRDADTFWYYDPSRMDKEQTAAFPMMRVPRGYAKHWWFGKLANGSHIAPGNYTLRFAALRPYGNPNISDHWDIMRMPVRNIQVLPYNGTNATIHRG

SEQ ID NO: 888 - protein, 948 aa, Trichoderma reesei
MKFSPTLGLLALVSGASSLTVTTNVDQLRSKQNTTVVPNTFIVELQPDFHPGLQPKDRFAKTKPGAKPNWRVRHQYNDTDIFYGVSVSFDSPVDLATLRTSAGVKNAWSVAVVPRPELRGLWGVNKGGTKLPDYRGSSDVNRPLDMGNVQKLHDKGIKGKGVQVALIDSGIDYTHPALGGGFGRGHKVALGYDFVGDAYDGSNDPQPDGDPLATCADGGHGTHTAGIVAMQDPKKQGFGLVGVAPEATLAAYRVFGCEGGATNDILIAAMIQAWRDGADIVSMSLGLWQAWEEINPFEDVVDKLTSHGVAVVASIGNFGTAGPYSSSTPAISLSALSVGSIESDIYPTAWTAHDDQHRAINYINVFPASELGRVEVVQLGYGLAVPITPNITSGCDQDAWDALSNAQLNWNTTILQVSWESWCGTAWGPAADLGVKALLVTMSEAQDILVDEPGSEPAALYLDIDNSKLLLSRLAKQPAGKKYALTFDGTKAVDVANPYGSAPDYFSSFGPTIEMTLEPKISAPGGTILSTFPVDAGGYAVLSGTSMSAPFVSGSLALLKSQNPRLTVPQLFARLMTTARPVNELNSKLTASAARQGAGMIDAYAAVTADTVISPAEFSLRDSASPAPQKITISNQSRSRKRYSLQHVPGTFYRLSNNYLSDIKDNFSSANLPLTLDIPASAQFSQSSVTLGPGQSVTVEVQIKPQPDMYPFANPVYSGFIKITADDDDEYSVPYLGVPYNRTEVGPIVHNVTTVKPYDSPGILKAQATNLFLADALTPTPNLETYNWTTDLDEAYIPVFRIDTIMTRFLRLELVPANVSFVPSMYGFDPDVHIDYKFPDQPILPGFLDVPTYGLVLAESLEPQPEGSPIMQSTDIGHFLGLALLDPSLTSDKGDKFRIAAGDYRVLFRTLRWRGNETNPDDYESWLGPVMRFDIPSDLPPDFPNSSE

SEQ ID NO: 889 - protein, 282 aa, Trichoderma reesei
MKISTVVTYSLLACHVYATPITFKRDILHGPIARSSRSFQQNRSEEIHHGNRASYSSIWSGAVIDSPPEGEAFNSVSASFVIPKPSIPEGSPPNNYYTVAAWVGIDGDTASKAILQTGVDLTIEGGQVYYEPWYEWWPDHSYTFSENLAISPGDVIKATVSATSSTSGFATIENVSTGKLVTKYLTSTYALAQQNAEWIVENYMMGLGASAHHTPLANWSSIVFTDTKASTRKSWLDASNATAINMAQNKTVITEVTIDGSSVIDTYIFTGKTPNLKADDTG

SEQ ID NO: 890 - protein, 201 aa, Trichoderma reesei
MTALASALFERSTDANSPQTLDRVWSGVKQSGSGFTSVTGTFTVPKGGKSFGPSIWVGIDGSTECPGGGLLQTGVRLTGNGTAFGWFEWVPLSAPVFEGFAVSEGDDVRMTVHAYGPFNGSAILENLSTGQTVSHTLTSADAPPDAPLCQKSVEWIVEDYNNSGGNDTGIVASPDYGTITIRNASAQGSAGTITPEGGELI

SEQ ID NO: 891 - protein, 637 aa, Trichoderma reesei
MKIGLIVLNSLLAGAIAVPAGLQIVHEKRDTSNARWTKREALNPNTKVPVRIALKQNNLDKGMDYLLDVSHPKSANYGNHYTADQVVDLFAPSPPSVAAVTAWLVKSGIPASSITASKSKGWLDFTTTSGQLESLLQTSYNTYQHVEARNVHVGTDEYRLPEEISQHIDFITPGVVFSPMKKSSGAEKRGEKGIRRASKPIPADIAQILRENPLATSTCGSAITPQCIRSMYNITAGTTAVSTNALGIFETGDTYAQQDLTLFWENFATNIPSSTGPKVDEIDGATAPTSPFNAGGESDLDFEIAIPIIYPQTTVLYQAAVKNDDIFNTFLDAIDGSYCTFSDDGETGDDPTIDGTTRNEQCGSFKPTNVISFSYGTAEADYPTYYLQRQCDEFMKLGLQGKSIVFASGDDGVARRSGPCLGPKRNIFTPGEPASCPYVTSVGATTLPSGKQPGDAETAVTTFSSGGGFSNIWTTPSYQADAIASYFASHDPGYASYNTSGGVIPTTGGIYNRAGRGYPDVSAVGDNGVVVNKEEEVLEGGTSMSAPLFAGILTRINEERIAAGKSPIGFANPALYANPSMFHDITVGNQAKGGPNGDSGASACGNTGFSAVSGWDPVTGLGTPDYPALLEYFLGLA

SEQ ID NO: 892 - protein, 1419 aa, Trichoderma reesei
MKSALLWAAPLSLLAGLGACGKNFDELLEVPEGWTQLNDAVNPSQHIRLSIAVKQPYIDSLEARMAEKGNRLSMQEVRELQTPAKKDIDNVLHWLSQNNLYGVVEKDFIRVWTTVAKAEPLLKMKLSRFSYEGKPAVLRTTKYTIPDSVADSISFINPINNFMSARHRERGLTFLLPPSKGAVLPGNTTAYCAGSVTPSCLSKLYNINYSPANTSSPVIFGVAGFLEENANLQDLRQFLNQSAPEVAKTGRTINVELVNGGVNSQELSESGIEAALDVDYAVSLGFPTNVTFYSTGGRGVKLNDDGQPIEGEDDDNEPYLEFFQYLLAKPDGQVPHVLSLSYSDDELSVPRDYAKRVCSLFGLLTARGTSIIFSSGDGGARGGRASSCLTNDGTKRQVTMATFPPTCPWVTSIGAVTNIAEPPNGARFSTGGFSQYFAQPRWQNEAVEGYVKALGGHLDGYYNESMRAIPDVSAVGTAFSIISGGYPRSVQGTSASAPVFAAMIALINDARLRAGKKSLGFLNQHLYSSEVRAVLQDITAGQSASCIWNDADIPGGWPAAEGWDAITGLGVPKRFDKLMEVLVNHLPRLATGFARFKMPTQHVEPESHALLQDVANSLLKARKVVVVTGAGISTNSGIPDFRSENGLYSLIQAQFDAANQPTRPAERSKADGTADSGEEPRPTKRGMTSREASPDLDEVTRQLRDDIEARAESQRPAASSRAAGTQPAVAASDANASAEGVCLSTPRRKPALPSTPLPTTSPLSSPPREDFLIPLPSWSSSSILRTEDRKRITDASHNVVSSPLSSPPPVLFDPFHPSSPSDEDRSRRSSTTPSEAGENPPNAMPASQTSSFGKANLPNMKGKDLFDASIWSDPTRTSVFYQFATSLRQKVRDAEPTSSHKFISHLRDRGKLVRCYTQNIDQIEEKVGLSTSLEDGPGSRGRFSRKATANASQLNKMVQEVSSGEGGASSHVNASSQSSNGSSEQSSAESSQANDRTEEEDSAGSSSTTAATTTTTTTPPDRPKPAPRKEPPQSGVECVFLHGSLQLLRCFLCGQVCSWDDDDREVETLSGLQPECPHCVGATEARQERGKRALGVGKLRPDIVLYGEEHPSAHLISPIVTHDLALYPDMLLILGTSLRVHGLKVLVREFAKTVHSRGGKVVFVNFTKPPESSWGDIIDYWIQWDCDAWVSDLQVRIPKLWQDPEPPKPKKKRDSGGAADDNREEKKRPPAQNPVALRDTKVNGAYCTLKILKELRRITYTRDSAAIGNPIITAPEPPTTTEAISRAVAMDSSRTSTPRGKSKRSRRSATGAIDRPKRTPSTLNPNHGRSKKPTAEAKKKQQEEEEVPETPSQPPASTVEEFSSILHSVKSNPRIRKRKMIDGEEFVFPAVGKKRGAVDSLYKGPGDDTKELPPLRPMP

SEQ ID NO: 893 - protein, 649 aa, Trichoderma reesei
MTGCGNAEGSHREWKRGSRLDPHAIIPLRIGLAQSNIHLGYEKLMEVSDPSSETFGKHLSQDEVHDLFAPAHETFDAVHSWLVESGVNASEIRQYENKGWLAIDLPVTHVEGLFQTQYHEHEREGELKIGCDQYYVPRHLSEHIDYIVPGIKLSPPMVRRSLERVPDTSSRKYRKGWRPKQMPPDLLSLVKKPPTTPKLPANLQDCARNFTAVCYRALYQIPATSHPVAGLEPAVYESGDTFAQGDLDSYYHKYAPWIANGTHPRILSVDGGEAPVAPDSEYNTGESDIDVNIIQTLVWPQTMVLYQVDDRLYTTANNYSGFLNHFLDALDGSYCHSTAFGITGDSPGIDPSYPDNRPGGYHGTALCGAYKPNKVISISYGEGEIDVPKNYFQRQCNEWLKLGLQGTTVLVSSGDFGVAMPPESDTATGCISGSGQNQTIYNPGNPVSCPYLTSVGATQLEPGTTVLDAEGAMQTNLGPGAELFASGGGFSNYFPAPDYQKAAVSKYFAKHDPGHPYYIANANASNIGENGGIYNRAGRGIPDISANGANFRAFNNGTEGHWFGTSLAAPLWASIITLINQERTKIGKGSVGFINPVLYANVDALTDIKQGSNPNCGTSGFTAVEGWDPVTGLGTPRYPSLLKLWLKLP

SEQ ID NO: 894 - protein, 459 aa, Trichoderma reesei
MREPEGLPVSSVELWIDSLMRDPKNRLAHAALSSSDPRQALTTRSSKVANQHVFNVRIPFEGDPITNQRSSGRCWLFASTNVFRVALMKRHGLASFELSQAYLFYWDKLEKANWFLEQVIQTAGDDLDGRVVQRLLSDLVSDGGQWDMVYNLVEKYGLVPQSLYPDSWSAMNSSALNGIVKTKLREHALRLRELCRQMPGAPPSFIGAYKMRMVQEIALVMTLLLGQPPRPSDEFAWQYVDRDGKAREVRTTPRAFAKDIYSAEFRVTADAIQGMISLVHDPRHEPLRKLTVSRLGNVVGGRAVTYVNVEMETLKAACVKMLKAGLPIFFGCDVGKFSDRAAGIMDLDLFDYEAGLNTSLRGMTKAQRLMTGESLMTHAMVLTAVHLDERTGRPVRWRVQNSWGTAAGENGWFVMSDAWMDEFVYQAVVDPRFVGKEVRDVLKQEPIVLPLWDPMGSLA

SEQ ID NO: 895 - protein, 310 aa, Trichoderma reesei
MKSSTLLSGALVAAAQVYTALGATAVRAHEVSHVIRANIQLPSQPPVPNAYRSQGCWSSKGNMTHATAVKSTTVSSGSCNDYCKSKEMPVSGLQGDECFCGMVYPPQGDQVEDSKCSFPCPAYPKEACGQIGQPGYFSVFNTGVNINPDYYEPPKSTTTSPSSTSTSTDAEKSSAAAGSSGIASASAEPTSADGGSKKKTNVAGIAAGTVVGVVVLGGLLGAAFFTLRRRRNAEIEEEHRRNAAVNAFINGSKPPSTSGSISMTDSRLDPIMAHRRLSDGSIADNEDYSRRILRVCRCLPSASFVSICPD

SEQ ID NO: 896 - protein, 491 aa, Trichoderma reesei
MKLWSSLALAGIVATRAVATEVLSPDAIEKDIEEKNLQNVLWNLNHIAENNGGNRAFGLPGYNASLDFVLERVQTRFASEFDTYVQKFTHLFESTRSISVTGPEGENVYVITLQYNTATPLPGGITAELIDTPVDDARGSACFEDQWAGIDATGKIALVRRGVCAIADKLKLAKAHGALAVILYNNVPGDSIGGATLSANNIGLLVPVGVITEEYGKGWKARLAQGEVLKATLVVDSINEPRDSWNIIAETKEGDPNNVVMLGAHLDSVQAGAGVNDDGSGTAGLLELATAFRRYKGFANKVRFAWWGAEESGLIGSLYYGSQLSEAEADRIRFYFNYDMIGSKQPIYAVYADTDAHKSGGSILFDYLQSKGKPVYYGGFGSSSDYVAFLELGIPSSGIFTGAGAPEDACYHQACDNLDNINWEAITLNTKAAGRAAAQLALSLDGIPPREKTSPNPSSRRAIERRLNRAAQLTKVIEKSHSCGGLGDHTV

SEQ ID NO: 897 - protein, 342 aa, Trichoderma reesei
MPTTTAETLSLVTRNVSVAPLVLLSAVDHYNRTVTSKTKRRVVGVLLGQNDGKNVRVSNSFAVPFEEDEKDPSVWFLDHNYVESMNDMFKKVNAREKLVGWYHTGPKLRASDLEINELFKRYTPNPLLVIIDVQPKESGVPTDAYFAVEEIKDDGTTTSRTFVHTPSIIEAEEAEEIGVEHLLRDIRDVAVGTLSTRVTNQLQSLQGLHLRLRDIGAYLQKVLDGQLPVNHAILGNLQDVFNLLPNLSTPEDDSRTGGHELSHAMSIKTNDQLMAIYLSSLIRAITAFHDLIENKIQNRQQQDEKEPKKDEAKDKDEKKDAGATNANGESKESSDKEKSKKK

SEQ ID NO: 898 - protein, 571 aa, Trichoderma reesei
MAVSKLSLLLAGVAGASAYIAAPARGYGQELLSSLTHSIAHPVTHPELQCELPPVLDPSGDGLPSADELFSSKSVRELQVQRLQAIVQVPSVSYDDLGPVGQDERWAPFFDLHDVIKETFPNLHKKAKLEKVNTLGLLYTIQGSDESLKPVLLMAHQDVVPVADESTWTYPPFDAVYDGKLIWGRGTSDDKNSLTAVLSAFEALLSNDDWAPKRTFVLAFGFDEECSGYRGAGKISEVLKKRYGKDSFAAILDEGGLGLLEVGNALYVLPAVTEKGHIDIFFELDVVGGHSSIPFPHTGIGIIAEIITELESHPFKAQLVEDGPVHNHLQCQARYSPDARPELTELVRQGDLDGLTQWLVRDGRSTQYVVQTSQAVDVVNGGQKMNAMPEKTILGVNYRVAHHNSLAEVQHNAVRRVANIVKKYGLTLKPFEGDDDYEKYVADLKTEEEEDVELKEVIDYKGTLILSTNGKSHPSPISPTRGAAWDVFAGTVRHTFRFDNGTVVPTGEIMTGNTDTRHYIGLSENIWRFTPDRFHAENNIHTIDEHSRVDGHIEMLKFYYDFVRNFDAAKF

SEQ ID NO: 899 - protein, 506 aa, Trichoderma reesei
MDGRPPLDNRACVNCISKLSPSEVCQVNWHVDTDNACRLCAVRDLKPEAFTKPFCDFLRENPTIFHTVEYFKTKLRQSGYVELPARDSWADKIQPGGKYWVTRNGSSLIAFAVGKSYKPGNGVGMIAGHIDALTARLKPVSKKPTAAGYVQLGVAPYAGALNQTWWDRDLSIGGRVIVRDEKTGKTSSKLVQLDWPIAKIPTLAPHFGVGMMGQNNPETQAVPIIGLESSDGSDSELLGSTGSFVNTQPPKLVKLIAKELGITSYDSIVNWELELFDSQPATVFGLDKEFITAGRIDDKLCSWSALLGLLHSTERDSDSYIKLVALFDDEEVGSLLRQGARGNFLPLTIERLVEALNPTTYGPGLIGQTFAKSFLLSADVSHAGHPNFLGNYLPEHIPKLNVGLVVCSDSNAHMTTDAVSSAILHRVADLCGAKLQDFQIRNDSRSGGTVGPMLSSAMGVRCADAGLPQISMHSIRATTGALDPGLGVQIFKGFLDFWEQVDGEWE

SEQ ID NO: 900 - protein, 395 aa, Trichoderma reesei
MKFLQTSLVAALPAALVSGRFVAENEGDHVILEEPAKYLIELGPGETQWVTEEDKWDLRRNGQRFMDITDTRDLGSLRAQFRAATVQFPDKCVKQKEVGQLAGNLSKDEMLKNLEKLTSFHTRYYKSDYGRQSSEWVLDKVNQIIKDAGASDTVTASPFAHSWPQSSVIARIPGKSNTTVVIGAHQDSINLWLPAILAAPGADDDGSGTVTILEVFRTLLGDKDVVGGSARNTVEFHWYSAEEAGLLGSQAIFQAYEKAGRDVKAMLQQDMTGYAQGTIDAGKPVSVGVITDYVDPGLTAFIKKVIEEYCSIPWVETKCGYACSDHASASKAGYPSAFVIESAFENSDQHIHGTEDLIKYLSFDHMLEHAKMTLGLVYELAYHDFSSARDEPSEL

SEQ ID NO: 901 - protein, 548 aa, Trichoderma reesei
MRLSTSALVLGAASSAMAFQDQKVLSDPSSKPAVKFGSDFESLASSLKESFGELTADAKAVWDEVAMLAPDAMAAFKEQVKGIKPKKHDRKPDGDWDHVVKGADVQKLWVEDESGEPRRLVGGKLSNYSLRAKKVNPEKLGVDKVKQFSGYLDDDEKDKHLFYWFFESRNDPKNDPVILWLNGGPGCSSLTGLFFELGPASINKKIEVVHNPHAWNNNASVIFLDQPVNVGYSYGSGSVSDTVAAGKDVYALMTLFFHQFPEYSHQDFHIAGESYGGHYVPTFASEILSHKDRNINLKSIAVGNGLTDEFTQYAYYRPMACGEGGYPAVLSESQCNAMDNALPRCQSLIKNCYDSESAWLCVPAAIYCNNAFIGPYQQTGYNPYDIRSKCEDSGNLCYEGLGYISEYLNKPEVMEALGAEVSSYESCNFQINRDFLMRGDWMKPIYRLVPDLLKQIPVLIYAGDADFICNWLGNKAWVTQLEWEHGDSFRSAEAKDLTVGDKTYGNVLSSHNLTWIQVYGAGHMTPTDEPEGSINFINRWIAGEWVAK

SEQ ID NO: 902 - protein, 538 aa, Trichoderma reesei
MHAVNLHARHDPEQRVSVRQYEDRYPNIKAYNFSVPIDHFHNESRYEPHSGDSFPLRYWLDISNYKPGGPVIVLHSGEFDSTERLPYLQHGIVPILTKATGGVGLIMEHRYYGTSFPVPDLTTESLRFLTTEQALADTAYFAKHVRFPGLEHLDLTASKTPWVIYGGSYAGAFAAFARKLYSEVFWGAISSSGVTAAVEDLWQYFEAARRYAPGDCGPTTQKLTHVVDTVLFGDDRAKVLGFKQLFGLGDLDDDDFATTITRGLYGLQSTNWDPEEDVSSLGIYCAVVTSNFQLFASTTHLIPTVQDLVAKAGFAAEAEVLSVRMLNYIGYVRDYVKTDLAKGCKGKSVSECFSPRYSTPNDTSLNAGWLRSWSWQVCTQWGYFVTGSGTPRDQLPMISRAITLESASSHCKRLFNITTSPDVESINKLGGFNFSYPRLAILDGLQDPWRSATPHASGLPDRESTTSEPFMLIDWGVHHWDEFGLPEDVHVEGLPPPQVAEAHMAEIEFVKAWLADWKEENGISMLQSMDEEETMGEL

SEQ ID NO: 903 - protein, 573 aa, Trichoderma reesei
MLRQVAARLQPRARAQGSRLLSTQSRFGAVKPLVPRRTMATVHIEGIHKEPTELDEITTLPNGLRVASEALPGSFSGVGVYVEAGSRFENESLRGVSHIMDRLAFKSTSKHSADEMLQRVETLGGNIQCASSRESMMYQAATFNSAVPETVALLAETIRDPRITDDEVAEQIETARYEIAEIWSKPELILPELVHTAAFKDNTLGNPLLCPEDRLGSINRDTVQLYRDLFYRPERIVLAFAGVEHGTAVKLAEEFFGDMKATLPRTGSESSLSSLASDASSSASSSSSSSSSTSSSLMSKIPLFKNISTSASRNASLLVPPSEEEIRQPSRYTGGFLSLPPQPPSLTGTNFTHIHLAFEGLPVASDDIYALATLQTLLGGGGSFSAGGPGKGMYSRLYTNVLNQHGWVESCVAFNHSYTDSGLFGISASCLPGHTSAMLDVMCQELRALTLERGISKLQEGEVTRAKNQLRSSLLMNLESRMVELEDLGRSVQVHGRKIPVRDMCRRIEALTVRDLQRVASMVMGGAVKNPGNGSGAPTVVVQEAQAYGVTSHTMSWDQIQDRIDGWKLGRRA

SEQ ID NO: 904 - protein, 384 aa, Trichoderma reesei
MHLNLLRASLVAPLLSLVGAALGIGTLTDDDLRSLPSPGQDFDIHTGKLLAPILIPRVPGTEGQAKTQKHFVDFFKTNLPEWEILWQNSTSKTPATGDKDIPFANLILRRDPPGYAAGEVGRLTLVAHYDSKVEPKDFIGATDSAAPCAMLMHVARSIDGALKAKWDDMAASGGLDDDLEPGIGVQILLLDGEEAFVRWTQTDSLYGARSLAETWESEFHPSMSTYRTPLHSISLFVLLDLLGSPNPRVPSYFLTTHWAYRKIAALEKRMRDLGLLESNSTHPFLPDAEKHPNQFGYGGIEDDHIPFLRRGVDILHLIPTPFPDVWHTMEDDGEHLDMPTVLDWTKLVLAFTAEWMDLSGHFPKAATKDKRSETMLEPSQRTEL

SEQ ID NO: 905 - protein, 707 aa, Trichoderma reesei
MMKPEELKHYLADQPPSVVRLEIEKHFALLTEKQKRYAHFISKAAFAGSRIVLRQLSPESEPIFDLIITLHKSANGDWNALAKKAGVDEAELNLFLEYVAMFLGNMGNYKSFGDSKFIPRCSETTVAALAATSPEAQKFYDATKGAIFSHDDPAAMHLGFLDAGHMTTYYPDSKDITKSEIEAVSTWMEEKRLLPENTRLRKTADGFDILIASAVTSVPPEGGDIGKETEFTVENGPLKGKTIRLVYGDHAEEMKNITAYIKQAAANADNENQKNMHLAYAKSFETGSLEAFKESQRWWIKDKGPSVECNIGFIETYRDPAGVRGEWEGFASMVNQERTRAFGELVNASPSLIPLLPWGKEFEKDKFLSPDFTSLEVLTFANSGIPAGINIPNYDDIRQTEGFKNVSLGNVLSAKAPNEKIPFIREEDLAVYQANRDAAFEVQVGLHELTGHGCGKLLQETSPGVYNFDKENPPVSPVTQKPISTWYKPGQTWGSVFGPIAASYEECRAELVAMYLSCEFPVLKIFGFGDGSEDINGPAGDVLYASYLSMARAGLASLEMWDPKSQKWGQAHSQARFSILKSFLEAGDDFCKLDYTKDDLSDLTIKLDRSKILTAGRDAVAKYLQKLHVYKSTADVETGTKFYTDMSTVGLDFWGTKVRQVVLDNKQPRKVFVQANTTLDEATDSVSIKHYDATLLGMIQSWADRNL

SEQ ID NO: 906 - protein, 620 aa, Trichoderma reesei
MGKANTTQKLAKLRALMKEHNVQVYVVPSEDSHSSEYIAACDARREFISGFTGSAGCAVITETAAALATDGRYFNQATQQLDDNWTLLKQGLQDVPTWQEWAAEQAAGGKTVAVDSTLVTASIAKKLAEKIRKSGGSDLVPLDINLVDAVWAEDRPARPQQRITVLSDKFAGKSVQSKLSDVFSELEKKRSPGLFISMLDEVAWLFNLRGSDIPYNPVFFSYAVITPKGAALYVDESKLDEECREHLNKCNVAIKPYESFFRDAELHHQQFVASAQSAEGASPSGSFLMSNKGSWALKRALGGDGAVEEIRSPVGDAKAIKNETEMEGMRACHIRDGAALIEYFAWLEDQLINKKTVLDEVQAADKLEELRSKHEHFVGLSFPTISSTGANAAVIHYGPERGNCAVIDPEAIYLCDSGAQYLDGTTDTTRTLHFGEPSEAEREAYTLVLKGNIALDVAIFPKGTTGFALDALARQHLWKTGLDYRHGTGHGVGSFLNVHEGPIGIGTRIQYTEVPLAPGNVISNEPGYYEDGRFGIRIENIVMVKEVKTKYAFGDKPFLGFEHVTMVPYCRNLINESMLSEAEKTWLNTSNAEILEKTKGFFEGDALTMAWLTRETRPIE

SEQ ID NO: 907 - protein, 463 aa, Trichoderma reesei
MVAQDFEAVLKGKYPGKSHASRVVDLIRKKDPNANGVLYLEGRMTKLLEDNDSPEPFRQRRYFYYLTGCNLADCYFTYDIQAAKSTLFIPPIDPHDVIWSGLPTTIDDALRLYDVDEVKLTTEVNATLAHLANATSSSTIYAINGQVSDHITFIGFENKDFALLKEAIEVSRVVKDEFEVAMIRKANHVSSLAHKAVVEKAKQASNEMELEAVFLERCVAKGAKNMAYHPIVASGTAAATLHYVANDAPLAGKQNLLIDAGAEWNNYAADITRTFPLNGKFTKEGREIYDIVYKMQQECIAVIKAGMYWEDAHILAHKIAIDGLLALGILKGDKDEIFKARTSQAFFPHGLGHYLGMDTHDTGGNPNRQDPDVIFQNLRLRGQVPAGGVVTVEPGVYFCKFIIDPYLENPEHSKYIDADVLAKYWDVGGVRIEDNVLVTETGYENLTTAIKEPGELEALMAAS

SEQ ID NO: 908 - protein, 795 aa, Trichoderma reesei
MANESTPLIQTVRVGPPRRRYRHHTLRRFCNIACVSLLLCGFASFALHSLYIWPSGQEHRHRHPHHPHHGHPDHGHKHLSHEDLQAILLDTPSSEKAEEWSRYYTSGAHLAGKNYSQAEWTKDRWEEWGVKSSIVAYDVYINYPIDHSVSLLEKSSDAKSWNVAFKASLTEDVLEEDPTTAAKDKIPTFHGYSASGNVTGSFVYVNYGTYRDFADLVEAGIDLEGKIAIARYGGIFRGLKVKRAQELGMIGVLIYSDPGDDGEITEENGYAAYPEGPARNPSSVQRGSVQFLSSRPGDPTTPGYPSKPGVPRAPADETTPSIPSIPISYADALPLLKALNGHGPRASDLNKWWNRKLGLGYKGVDYNIGPSPEDVVINLYNEQDYVIAPQWDVIGIINGTIPNEVIIVGNHRDAWIVGGASDPNSGSSVLNEAVRSIGKALEAGWKPLRTIVFASWDGEEYGLIGSTEWVEEYLPWITDANVAYVNVDGGASGPQFSAAAAPLLNQVLRDATHLVPSPNQTVAGQTVGDVWDGKISTMGSGSDFTAFQDYAGIPSLDMGFGGNGSGPVYHYHSNYDSFHWMSEYADPGFVYHRTMAQVLAVLVGELADRVVIPFGATEYADALDSYLDKVEAKLQPADADLATDDEIFAVRGSVSSHEVIGSQDAFEESLKKIRHSISEFRDKAVKLDERAAWAKKKLEEGLPWWNIIGKARLGLTIIRVNHQYKYIERQFVFEGGLDNRSWFKHVVFAPGLWTGYAGAVYPGLVESIDAKNYSNGLKWAGIIKHAVDKATKSIQ

SEQ ID NO: 909 - protein, 994 aa, Trichoderma reesei
MRLPNPFSFRPGPVTFWTTAVYLALVIPLIYVHETVPSAPSSHSLKQGLDLDEAWLDLQLMTRQYHPYNSRANTEVREFLIKRSHEILDRNGVPYRTEKTGGVIWDARANANANDELRAKRAPGATIFDDRISNVTWTVDSLLQSTKGGSKTWQGYYFEGDNFYIYIHGQEDPEGDWWTSQAGAASYSRSGGVLVNCHFDSVSTGYGATDDGMACVSMLQLLSYFTTEGQQPKHGIVLLFNNAEEDGLLGARAFGYSPLLKFCHTFVNLEGAGAGGRAMLFRTTDLEAAKAYSKSPHPFGSVVAANAFERGVIKSGTDFEVFAPDFGQRGVDIAFYQPRARYHTEDDDARHTSVRSIWHMLSAALATAERFSELTDTVFSGDRRDGDKDLVQNGKPTEGVYFDWYGSGWSAFPLRGLFAWSLTLLLVTPLVLIVVTYLLIRQDKYYFFAKDVELENSELHDDPIALGGWRGFFRYPLALIFAVGLTLGAVLLVAKVNPLIIYSSGYAVWAMTVSLFYISFFMIMRGANFVRPSALHRGFALIWLFILSWIVQVIAAVAEDRMHIGGLYFAAFFHTAVFVSLFISLVELFALPGKEDFANQFQDDAAPSHIRVTSSDNTITGHEDDQEDATETTPLRAREHSYGSSDHPTFASTYRRSAHLDDPAPSDLISFPPYEHEQAWSGRLPTWTWIVQFLLLAPIHIILVGNLALVQTSAMAMNGADGGSLLPPIMGVGIMTILLLLPLTPFMHRITRHVPQFLFVVFVATFIWNLAAFPFSNNARYKLYFQEVIDVDAGTNVATLTGIPEYLHKVIDSIPSATGQDVECRASTRLGLTTCEYDASSLPPYLANGTDPKDLITVSSSRSSDGTTANLKVDALDTKMCILNLTRPVFGFTINGGAPPDTRFGTIPRGGLRGITLFRREFEGPWDVDLQLTGEDDVLDEDELEVTVKCAYSDMNDDKTIPVLRELYQYMPKWAVISKTAVALVEVRKKFTIS

SEQ ID NO: 910 - protein, 459 aa, Trichoderma reesei
MHGRDSPARSGHPSESGSYGQEWAHGLSVRFEGMMRDKRMNDLRSLSLQDRPSNAYREASPSSDYLRSSHSSTTPPSYSALRHLPKIPTPPAAADRDSQKFRNLLLSLSLTPTKYENPGLLDEALQTIPLDRIYGEAEEESQVLQAQAESMGDGRRPEWGYQDCVIRALLRWFRRSFFTWVNNPPCPVCLSPTIAQGMTAPTPEERACAALRVELYRCSAESCGAYERFPRYGDVWRLLQTRRGRVGEWANCFSMLCRAVGGRVRWVWNAEDHVWTEVYSDHQKRWIHVDACEEAWDNPRLYTEGWGKKMSYCIAFSTDGATDVTRRYVRTNEAANERNRCPEEVMLYIMQEIKNLRRANKSKEERFRLEKEDQQEDQELRGYVVATIAQAVTDIIPGASSSAGNRGGSGSGSGAGQDTKLPAENLSRQVGSTEWLAAQQRQHDRQCQPRDPSHRRHLP

SEQ ID NO: 911 - protein, 529 aa, Trichoderma reesei
MLKSICTNSLLLLSASLLPTSAASQEAQVHLTAPSKHHHQVDPAILAALEKHSDPVDAFVSLHPEAAEQLSQPRLLHVVGEPSAQWMTEGDKLRLKRQGKKFVDITDHEDFYKEQVHALAGEAHLPKLSHQRLVKSLLPRVSTEKMHDVLEHMTGYYTRYFGSVTGEESSQWLYNHIAEIIKNAPFHTHISLEFFTHSFPQSSIIARFEPKVRNFSLPLTILGAHQDSMNYLFPLLPAPGADDDCSGTVSILEAFRVLAESGFIPSNGPVEFHWYAAEEGGLLGSQAVARYKKESGARIGAMMEFDMTAFVAKNATESIGFIETEADAPLTSWAADLAKEYISIPANIYRLPSGAGSDYMSYTQLGYPAAFASEGNPTAGEAEAGNGEFDPYIHTEKDTMHIDDETGVFSLEHMARFSELAIAYVIEQAGWDNKWSLRKGAQACHDCCLKTIERYGKSPTEQKAELRTALCCCLVGYYSMVQLEIYPVAYHKLIGMAVLGTIQAREPSIPCHSSDDWRILSHARLTRRD

SEQ ID NO: 912 - protein, 421 aa, Trichoderma reesei
QWTGTVDVTPSHRLFFWFFNSRNDPVRDPVIVWMNGGPGGSSMMGLFNELGACWLDPGANATVPNPFAWNNNASVLFLDQPAGVGLSSRSPGSPLQAHDVDGAADFQAFLNIFFGKIFPDRAHLPIHIAAESYGGHYGPVYLKHILDSRRFDSPDAFRGNISSLILVDAVIDFAAPAVGTYEFLCRGYGHHGKIMNDSTCDALRRSVPKVFELDRNCDAGNDGYECWGMTTFLEEVVHPYYYAEVEAGKRNPFNVHIPCPNWPWCADIRKGNITAYLNQPAVKAALGFPPSFTFEDVDIPLNAAYTLSKDPFRPTARQVAAVLDAGIRVLVLQGNEDYIVNTPGNMWAYDNLRWSGLADYRLAHWRPLPEGVAATGTWKAGGEGGRLAFVAVDGAGHTVPGDVREGSWRIVKEWLEGGWRG

SEQ ID NO: 913 - protein, 240 aa, Trichoderma reesei
MPTEGVFIRPSGQKTFIPLENNPEVFTSLVHDLGVSPELGFYDVYSLDDASLLSTVPRPVLALIFITPAEMYFAVRKQDGTTVSPEHLTYDKSGDDEPVLWFQQTIGHACGLMALLHSGFFLDGLLHETTPLKPVERAAALYNNEELEKKHMKAARTGTSQPPEASEENHFHFISFVKGKDGHLWELEGATDGPLDRGLMREGDDVLSEGALDMGIRKFLKVGNGNVNFSIVALAKKPAE

SEQ ID NO: 914 - protein, 1803 aa, Trichoderma reesei
MLICPRWSSFTYPTPPSTPSEGSLKPCFFFLRDNSCKFGARCKFSHNVSSSTLPARQPYGRHPGAPSSLPGNRHDRSSEGKLSTWKRMLKSGQDTARPSQAIVSQFLKLAVELMDGDVGGAQETIRLLVTEAGLSFIKDVIDRHIPMDNISITGNRLWETEIKPLFQLVTHPRVVDSAVLEQEVAAIFNYLVGVGGARMNKLFHYVVSLFQQWPPTSTQGSLIEAVELSLAVLAKMLDCNTTNIINEAFSTFADSLASPLDKSEEPDEMVHRLQAKKHLHYIRQRLQIGDELPDLATRPQASVTRETFMLTRDLPGRLSRGGPRHNNDHANIAHIKILPTYEEIMSPREEYLPTNDCSQWHIPGIRGRLDREFRLIREDTVGQLRDAVRDAFTQIRGATAGVSHHANSNNLRTYTYGSAALIDLQFDTNTGLDLIVRCAQPPAVRALSARQRRDWWEKSKRLQAGALVCVLDGTESVMFCIVSESTMRNKDDKKDRFEKKPADEDLETPEKREPLTLSDNESYLHVNLQLIDANPDDVAQALDWYTGIKSSHHRYLVEFPGILLASFKHTLDALKEMSQRPKMPFVDLLAPTNVTTTEVDLQPPLYARKAGFAFDIRCITNDQAELLVSPQRPLNPRLIESRTTLDRTQSSALLNTLSRELSLIQGPPGTGKSYSGEKIIKVLLANKRIASIGPILCVCYTNHALDQLLEHLLDDGIKKIIRIGSRSKSERLQALNLRMVSQNSDRTRSEKGSLWDIQQELNELRNSMKDSLQRLSASDSLQSIKTFLAHHFPRHHDALFGVEEDGWQTVGNRPDVALRRWLTGGSRDNTHCRDLGVLRQTRLSVMNHAERQALHRDWLESIVAPILRTITSLQSEYAELMERRGRVRSDVDLRCLNQADIIGVTTTGLAKNLDLLRKLRCKVMLCEEAGEVLEAHILTALLPSIEHAILIGDHLQLRPQIQNYELQSTNPRGRQYSLDTSLFERLVEPPHLTDLRLPFSTLETQRRMHPSISELIRSTLYPSLQDGENVMNYPKVAGMKDRLFWLHHEHLEAGAASHDPLNTSHSNDFEVEMTVSLISHLVKQGEYSQDDIAVITPYLGQLHKLRRRMQSMFEICLNDRDLAELEDFEDRDGEAPMTAKWKQSGKTTLLKSVRAATVDNFQGEEAKVIIISLVRSNLQKKCGFLSTSNRINVLLSRAKHGMYIIGNSSTYYNVPMWEQVIDMLTASGRLGTHLELQCSRHPNTPIRVSKPDHFLQFSPESGCNLPCDKRLHCGHSCTASRSRAATGCLRPSAGRIKIPLLFAARSPSDARCQAAVMRSRCNATKTCVGPSLCGEACPDKAFCQQCASESVRSICVDFLEMKEYHEINLDEEPCIFPDCGHFLTTSSMDGQMGMSAYYDMDEEGHPTRLSKTSEPFSLDKSGIPVCATCRGSLRNIARYGRIVRRAILDESTKKFLAWSHEQYLSLANRLIKEEEKLAQGTAGHAGQDNTGPSSLKKGQFIGSAQRLKQLRELQRMVGKERYDSIIELWRQIGRHANNVRLEEQPFQRVADLVQFANRENKASREEFRYDESVVQVKGSLLADALLLKCEIAILFDFHRWMTRGGLAQAETEVKLDLSAHWSDCVRLIEQSRLRKYVREEVQGHIFAAQLCGLCLSFDESASMWSANKGAKKEQTPDSLREEALSHIQQARTILSQYPSTASFQGEIDNVEMLINGGIYRRVTAEEMRAVYSAMTSEFSGTGHWYTCENNHPFTIGECGMPMQEARCPECGARIGGQNHRAVAGTRHATEIENLARGMNGLGL

SEQ ID NO: 915 - protein, 419 aa, Trichoderma reesei
MKCLALLSAFLASASAAAVQPHRVSYNGYKVFRVSVEESNIGRINDVVDRLNLQTWKPAKKAGSFADIVVHPDQLEAFQQETQDLKPVVMHEDLGLSIEAESSSQNFAINAVNSTWFNSYHAYADHLQWLRDLSAQFPNTSEIVTSGNSLNGNPITGIHFWGSSGKGKKPAVILHGTVHAREWITTLVVEYFAYTLLTSTDATTKGLLDKYDFYFFPVVNVDGFLYTQSTDRLWRKNRQTNSGSSCIGRDINRNWNYMWNVPGGASTNPCAEDYKGAAAGDSVEFKALSAFIQKIKTAQGVKLYIDYHSYSQLFMTPYGYSCTAVAPNNSELQSLAKGAVAAIRAVHGTSFDYGPICSTIYQATGSSVDYVSDVIKADYTFTSELRDTGRYGFVLPADQILPSGEEAYAGFKYLLQNMK

SEQ ID NO: 916 - protein, 460 aa, Trichoderma reesei
MTAKSHAILPTAGSPDYRNPSAANSHAQQPPHRPNLKKLALGASLALATIGLLYKPAFSHYQRISQHSCSKTLTVEERAHKILSTTPLIDGHVDFPLVLRGPYGNHLTGDDFTGPFENGTLKGHVDLARLRAGRAGGAFWSVYAPCPANGTDFSDDNYADSLQFTLQEIDIMKRLFAAYPDDFAHDIDSSDAIDAFRAGKLISPLGIEGLHQIANLAGNLRMFRDLGVRYATLTHNCHNKFADAALLESPFRKATPVWGGISPLGRQLVHEMNRIGMIVDLAHVSEDTMIDALGGREDWEGSKAPVIFSHSSAYGICPHPRNVKDKVLQLVKETDSLVMVNIAPQFISCIDNGNDNGVPDEDPDNATLERVVDHITYIGSRIGYDHVGIGTDFDGIGSVPKGLEDVSKYPDLIAELLRRGVSDADAAKVVGDNLIRVWKAVDAISAEMKANGAPVMEDKL

SEQ ID NO: 917 - protein, 318 aa, Trichoderma reesei
ADAPSYRDELLQLLEALVSTPSANGQENEVGQFLVDYLQQAQYQVDIQFVPPPKDHPDVPDRFNVLAWRGDRKPSYKALVTSHIDVVPPHIPWEIQGGEISKKTIIKGRGTTDAKGSVATQIVAVNHLLSTNSNVNPEDLILLFVVGEETTGDGMRLFSDSLKHMDPPLSFDSAIFGEPTENKLACGHKGALFCSAVAKGKDAHSGYPEMGKSANELMIRAMGKILDTDLGSSPLFGNTTFNVGRFDGGVAANVIPAQAFVDLAARVAVGSERQGHRVVQQKIADILKETDEDAFTLECTHGYGPYECNCDVEGEFLD

SEQ ID NO: 918 - protein, 885 aa, Trichoderma reesei
MCRARAGLEGGSAAAPKRELLPANVVPRHYHVTVEPDFDKLTYNGSVVIDLDVAETSSFISLNTLELEIHGAKLSSGGQVVSATPAISYDENSQVTKFDFDGSHTLEKNSKVQLAIDFTGQLNDKMAGFYRSKYKRPDGTEGILASTQMEPTDARRAFPCFDEPALKAKFTVTLVADKNLTCLSNMDVASETEVQSKITGGTRKAVTFNPSPLMSTYLVAFVVGELNYIESRDFRVPVRVYAPPGHDIEHGRFSVDLAAKTLAFYEKAFGIDFPLPKMDQVAIPDFAQGAMENWGLVTYRVVDLMLDEKASGAATKQRVAEVVQHELAHQWFGNLVTMDWWEGLWLNEGFATWASWYSCNIFYPEWRVWQTYVTDDLQSALSLDSLRSSHPIEVPVGRADEINQIFDAISYSKGSCVLRMISTYLGEEKFLEGVRKYLKKYAYGNTQTSDLWDSLAEVSGKPVHEVMTAWTKSVGYPVLTVTEKEGENAIHVKQNRFLRTGDATPEEDKVLYPVFLGLRTKDGVDETLALKEREKDFPVPSLDFFKLNANHTGIYRTLYTPSRLEKLGQAAKEGLLTTEDRAGMIADAAALSSSGYGKTSGFLNLLKGFDAETEFVVWNEIISRLGSIQAAWLFEDQAVRNGIRAFLRELVSAKAHQLGWEFSDSDGHVEQQFKATLFGSAGLSGDETIISASKEMFAKFIAGDKSAIHPNIRKSVFAIALKYGGKEEYESIIKLYHESTNSDERNTCLRSLGRAKDPELIQRTLSLLLNGEVRDQDIYMPASGLRTHPEGIEALFNWMTENWEELYKRHPPNLPMLPAMVSLLTSGFTKPEQLARVEKFFSDKNTNGYDQSLAQSKDSIRSKISWVERDGQDVADWVKTNGYLE

SEQ ID NO: 919 - protein, 690 aa, Trichoderma reesei
MTITAQKLTPEVLLAAPRRSPGVPNATGELVLYTVSTYSFDSHSKTAQIRVLNLKEGTSHLVSEDSAASEPIWIAEQEIAYVKSLDHGASALVAQHVFNPNESNTIQRFGGSINSLKAKPLSTDKVAFCCAALTTPDGRMYSPAAEPKSYTSAKIYTSLFVRHWDSWNTENKNSLWYGQLNKVDGKWTLGNSELTNLLAGTRLHSPVPPFGGTGDFDISTTGIVFVAKDPDLNHARTTKTDLYFVPLNSYLDQPTFPQIVKTGALRGYSLSPVFSNDGKQVAFLRMKSQQYEADKTRLLLIPDVTDLSNVQEFYATEDGKGGWDYKPDWLIWSHDDKELYVAAEKHARVVLWKLPSSPLEAKSLPTPIHEDGSVAEARVLGKGSSLLITTRSRVESSNYSILDPASKSTTIISSSSRQGKTFALSKSQCQEIWFNGSKGYPIHALVTLPSTFDSSKKYPLAFFIHGGPQGAWGDDWSTRWNPAVFAEQGYVVVSPNPTGSTGYGQDHTDAIQNNWGGDPYIDLVKCFEFLEEEVNYIDTTRAVALGASYGGYMINWIQGHDLGRKFKALVCHDGVFSTLNQWSTEELFFPEHDFGGALWENREGYEKWDPAKHVGNWATPQLVIHNELDYRLPISEGLAMFNVLQARGVPSKFVMFPDEHHWVLKPENSLVWHREVLNWINKYSGISEKN

SEQ ID NO: 920 - protein, 498 aa, Trichoderma reesei
MAPPQAALDFVDFVNASPTPYHAVKSAAALFEKAGFTLIKERDSWASTLRPGGKYYLTRNGSSIVAFTIGRKWRPGNPVAIVGAHTDSPCLRVKPVSKKTNVGYIQVGVEKYGGGIWHSWFDRDLSLAGRVLVREGDNFVQKLVKVEKPILRIPTLAIHLHRQTNFDPNLEVEMLPIASLAAAELNKGKPTESKLEEPKDETMHDGEDEDFHPLEKMTVRHHPAMLDVVASEAGVDVASIVDFELVLYDTQKSVIGGINDEFIFSPRLDNLGMTYCSVEGLISSVSASDALDDDSTIRMTVCFDHEEIGSESAQGAHSNLLPAVLRRLSSLSLPTDAASDGSYEHVHHESDNPTAFEQTLSRSFLISADMAHAVHPNYVGKYESSHQPAINGGTVIKVNANQRYATNSPGIVLFQECARKANTRIQIFVVKNDSPCGSTIGPGLAAKLGIRTLDLGNPQLSMHSIRETGGTEDVGNAIKLFAQFFRSYGEIEPRILVD

SEQ ID NO: 921 - protein, 482 aa, Trichoderma reesei
MLQRLAIPAAKLLRRSSHIVPGQLLVTEHFFQVPLDYANPSASTITLFGRSATKHESPVVPPDEPPSPRPWLVFLEGGPGFGNREPQDHPLTRVALSHGYQVLYLDHRGVGLSTPVSTEMLARLPGAGGGQGPDAVDVQAGYLKLMRQDNTVRDCEAVRKLLTEGLPEHKARWSIFGQSYGGFVSISYLSLHPEGLREVFLTGGLAPVGKSADQVYQATFQRTLERNAAYYQKYPEDVEVLRQIAAYIEKEGGEQGLPLPGGGFLTVPRLLTIGIALGFHGGIDQIHAVLLQLKASLDQLGFLTRASLALLESFTPFDTNPIYAVLQEALYCDGPGSVSNWAAYRVGKALSQFSWLASGNTGASSSVPVDQPLLFAGEMVFPLHFETYPELIPLRAVAERLATASDWPALYDVEQLRKNEVPVYAAAFIHDMYVDYGLSMDTAKLIRGIKTYETNVMYHNALRAKAEEVLQSLFALRDDVID

SEQ ID NO: 922 - protein, 892 aa, Trichoderma reesei
MAVLPTLEASDCAESQPELLHSLKHSSSVLALAVSPQHDSIYAGTQDGEIVVWSLSTFHQVQQVQAHKRSVMSLSLSPDGRYLFSSACDPIINVWCPRTMVRLFEIYGNHDVGDIFSTAYSEQHDTLYIGAQNMTIQWVTLSDPTIKSTPDSQRHPDRRSHRFFDSKAVGGTSTPRRSEDKWGLIPRAETVLEIDSGSVRKFAHYGYVYCMLIAKGPTVEVNPDDEVLISGGGDGTIKLWSLDKPGRSDSSNPQHNGLREIMCLGTDDAESVLSLALDGSFLYAGKLGGIVELWDLDTAQRLRVIKAQNHDIMSLQMGWGYLWTTSADGWASKFSTAHYGKYQHVSRNVAQKYQCLNKWKAHSGKEKTKILASACSTYKNERYYITGANDNDICVWNIKDEAESTADSKSPTEDDVLLSALNEFVSYKTVSSRPEFAEDCRKGATYLGALFKRMGGYVEMLSTGDSHNPVVLAKFSGKKESADTRKRILFYGHYDVVPADNEKSKWAADPFTVRGTNGFLYGRGVSDNKGPILAALFAVTDLMQAQKLENDVIFLIEGEEESGSRGFEQAVQRNKERIGSVDYILLANSYWLDDEVPCLTYGLRGVLHATVCVDSSRPDTHSGVDGSYINDEPLSDLTTVLSRLKGRGNRVTIPGFYDGIPPVTPEEEARYDDIASILVRRSPEAASEAEIKKSLLARWREPNLTIHRYNVSGPDGSLVSSHASAHLSMRLVPGQEVNVVAMALTLFLQREFESLGSENKLKIRIDNKAEPWLGDPTNYIFRTLCTAVVEAWPERFETSSGAAQDACSEEDGDKKAPSEGSAASTGKPKKPLYIREGGSIPAIRFLEKEFGAPAAHLPCGRASDAAHLDNERMSLINLVKAREIFGKVFARL

SEQ ID NO: 923 - protein, 910 aa, Trichoderma reesei
MAPRASDRLERSPSTDSLSSVSTTSIVFDRIQEEMEKGEVPPKARARLGYSDVYAEDPLKDEASGDAETEAFLGSTGAALQRRPMDRKLRRFLCIGAVIFAAAWLASLAVFVSTGSYKHASDVEHDPDADFRGSGKPVTLEQLYDRFWSPKQKSISWIAGPHGEDGLLLERGASGKDYLIVEDVRSAVGNATAAAAAAADETAQLAKSRTLMKHADFEFDGKTYQPQWLQPSPDQNKVLIGVAQEKVWRHSFTAIYFIFDVETQTAEPLVPSEAQARVQLAGWSPRSDSVSFTRDNNLYIRRLTGDGGIVQITKDGGPEYFYGIPDWVYEEEVFSGNSATWWSDDGKYLAFLRTNETGVPEYPVQFFISRPSGHTPPSGEESYPEVQEIKYPKAGAHNPVVDLHFYDVSKGDVFSVSTGDEFPDDDRIINNLVWAGDKVIVKQTNRVSDILKVILIDVNKRQGSTINTIDVNKIDGGWFEISHSMTYVPADPENGRPEDGYVDTVIHNGYEHIGYFTPLNNSEPIMLTSGSWEVDDAPSAVDLANNLVYFVATKESSIQRHVYSVKLDGSELKPLTNTSAEAYYRASFSSGAGFALLTYRGPKTPYQKVISTPSTTIAYDVVVEDNAELADRAKKHELPVLKYGTIDLDTGVKVNYLERRPPHWDPKKKYPILFQQYSGPGSQQVTKAFTVDFQSYVASNLGYIVVTVDPRGTGFLGRKHRVPVRSQLGLLEAQDHIAAARHFASLDYVDASRLAIWGWSYGGFTTLKTLEQDAGRTFSYGMAVAPVTDWRFYDSIYTERYMRTPQENDKGYALSSIANATALGENKRFLLMHGVADDNVHFQNSLTLLDKLDLAGVENYDVHVFPDSDHGIYFHGANRIVYDKLNNWLINAFNGEWLKVSHPKPIGKKA

SEQ ID NO: 924 - protein, 475 aa, Trichoderma reesei
MYRKLAVISAFLATARAQSACTLQSETHPPLTWQKCSSGGTCTQQTGSVVIDANWRWTHATNSSTNCYDGNTWSSTLCPDNETCAKNCCLDGAAYASTYGVTTSGNSLSIGFVTQSAQKNVGARLYLMASDTTYQEFTLLGNEFSFDVDVSQLPCGLNGALYFVSMDADGGVSKYPTNTAGAKYGTGYCDSQCPRDLKFINGQANVEGWEPSSNNANTGIGGHGSCCSEMDIWEANSISEALTPHPCTTVGQEICEGDGCGGTYSDNRYGGTCDPDGCDWNPYRLGNTSFYGPGSSFTLDTTKKLTVVTQFETSGAINRYYVQNGVTFQQPNAELGSYSGNELNDDYCTAEEAEFGGSSFSDKGGLTQFKKATSGGMVLVMSLWDDYYANMLWLDSTYPTNETSSTPGAVRGSCSTSSGVPAQVESQSPNAKVTFSNIKFGPIGSTGNPSGGNPPGGNPPGTTTTRRPATTTGSS

SEQ ID NO: 925 - protein, 70 aa, Homo sapiens
GPETLCGAELVDALQFVCGDRGFYFNKPTGYGSSSRRAPQTGIVDECCFRSCDLRRLEMYCAPLKPAKSA

SEQ ID NO: 926 - protein, 177 aa, Homo sapiens
DSSPLLQFGGQVRQRYLYTDDAQETEAHLEIREDGTVGGAAHQSPESLLELKALKPGVIQILGVKTSRFLCQKPDGALYGSLHFDPEACSFRELLLEDGYNVYQSEAHGLPLHLPGNRSPHCDPAPQGPARFLPLPGLPPALPEPPGILAPQPPDVGSSDPLAMVGPSQGRSPSYAS

SEQ ID NO: 927 - DNA, 20 bp, Artificial Sequence
  Primer
gctgttcctacagctctttc

SEQ ID NO: 928 - DNA, 14 bp, Artificial Sequence
  Primer
agccgcacggcagc

SEQ ID NO: 929 - DNA, 20 bp, Artificial Sequence
  Primer
ggttgacttactccagatcg

SEQ ID NO: 930 - DNA, 20 bp, Artificial Sequence
  Primer
ctgaagcaacaggtgccaag

SEQ ID NO: 931 - DNA, 22 bp, Artificial Sequence
  Primer
cctgacgctatcttcttgttgg

SEQ ID NO: 932 - DNA, 22 bp, Artificial Sequence
  Primer
cgcgcatgtttgtccatcaaac

SEQ ID NO: 933 - DNA, 20 bp, Artificial Sequence
  Primer
caaaggccgaaggcccgagg

SEQ ID NO: 934 - DNA, 20 bp, Artificial Sequence
  Primer
caacctttggcgtttccctg

SEQ ID NO: 935 - DNA, 20 bp, Artificial Sequence
  Primer
ggccgcaggcccataaccag

SEQ ID NO: 936 - DNA, 20 bp, Artificial Sequence
  Primer
tgagtgggggatgacagaca

SEQ ID NO: 937 - DNA, 758 bp, Trichoderma reesei
gtttcccagctgagtgagcaaacaactcgtttccatccttgccaacaactaccactgcaacacctggaagatcgtgtttggcatcaacgcaggccttgttgactgagccttgaagattggaaagggtttcagcgctcagagacatctcgttaactgattaatgaaaaaggtgaaactgtcggctcacaggttatggttaatttgcatgctagataatgcacacatgcgccttttgtgtgtttgtcacactcgggtatgcttgtcccgatctgcgagctcggcaggttttcgagtctgtgaaactctgccaagttcttgaaaaggtcccatgaccctgttgatacggtgcggttgcgtgtccgcaactcctttccgcatattgcgtgcggttccgcatccctgaatcccctcttttcctcttgttttgccagtagagcctcctcaaccagccacaagatgcaaccccggacagatggcttagctgcggggaaatcgatgtctcaatctcaaccgcagtgggaactggcgacactgtcttctttgaagtgatacaagcttgcttgagttgggaggaggtactgcggattgcaagctgatattgcttcattactgtgtgttgagaatgggaacgtaggataagccgggtctttagatttaaggctccccatcccccaaagatgatgcagttcattcctttgtacatcatcattttcctacattatctcgactgactgtagtctacactctgtatttcagac

SEQ ID NO: 938 - DNA, 1000 bp, Trichoderma reesei
acggagctggagctgccccacgtggccggatagcatcgccgggagctgatcggggagttaacagactagatgctgattcgttcgattgttctttgcaaattgaggattcattcataggtcaggtctgtctacatctgttggtcagtctgttcttctgtgacgtatgagatacagacgatggcgagttcaaagagaaagcgcagcggtggaaaggctggcgtctccttcccattcaatcgcccttcacgtgcgcagccttgagatgaaacaccactgcagacgtcgaaatcgtttcaccaaccagcgtgacgtctctcttgtcatcctcttcctcttatcatctctcttgtcatcctcttcctcttatcatctctctcaaccatactttagctgtgtaacctcaaatcaatccgtcaagccgtcagtcacggccccctcgacatacggagtaccgcagcttgtccaatcagctctcgccatttccatcaccctcactcctccaggtcacccaacatgcagcaaggcgaccatcgtgagctcactttcgctcctcctccccaggcatccaccagataaacactccgtttgcgatccactgtgcaaccctccgtggcatgctgcggcctcttgcatgcgtaaagctgctgacaagacgccagtgattcattctggtggagcaaacgggagggacgagctttgatgttcaccactgagaccctgatctacccctcatcaactccatcacgcctcacggctctgcgaatcgaatgcgaacaatcccctgtcctcgcctacctcaagctgcgcgagctgcgcaagctgccgtaggccacccgccttagctgtgcgctagctcggttgccttttcatgtgagctcgcggcatatacggacgaggggcgatatatcagcgtcgagaagccgtggcagcctgctcgttctatttcgtcttttctgatgccgcgaaaacagccaccagcaaccatttctgaaagaccgca

SEQ ID NO: 939 - DNA, 1000 bp, Trichoderma reesei
gcttccaacgccgccactcgcctgatcccctcgctgcccttcattgaggccgagattcgccatggcgctcggtccgaagccgcttgcaccgccgccgatctcatctcccgccgcatgcgcctcgccttcctggacgtcgagaacgccctgcgtgcgctaccgcgtgtcattgatgtcatggccgaggagctcaagtggtcaaacgatcgaaagcaaaaagaatggaaggagaccatctcattcttcaggtcaatgggcttggaagaggctaagcagaacattacgcgcaaagaggtcgaagcactacctgctctgcccagccgaaaccctagggttgcgaccacggccgagcaggaggagctgggcaaggttgaagccaacggcgtgctggcttaagcttgagtgagacgagtctgttcttgtacatatggtgttcagggaaagggtgttttgctttgtttgcttcgtcttcggagtctgatacctggagttgggatcggaaagaagggtacaagggatctgctatgcagggtagaagcagcggttggattttcagacaaagtacgggcgttatagacggcttctcattgttactgatatatacctacaatagcatcagcgattatcttgaatttgttggatccctgcgtgacacgctcgatgtggatgatacttgacttggtgatgaacaaatggccgctgggtggtggcaggaagaatccagtcgcaaatgcaagcacaatcggctcttcaagcgggggagaggaaacggaagcccagcaaagaggcagttgcagaggcatgtgctatatatacctgccacgaccgaatgtctgcagcacaggattggagtcttgacacattccgccagcattgccatcaacttcagtgtcggcttttggaggatcagtagatattttttcttacgagcatttctttctggcgtctttcccaccgtcgccacacatatagacacagctgcgtccaaataacagcaaag

SEQ ID NO: 940 - DNA, 20 bp, Artificial Sequence
  Primer
gacactcccttgactgtagg

SEQ ID NO: 941 - DNA, 19 bp, Artificial Sequence
  Primer
catcccccaaagatgatgc

SEQ ID NO: 942 - DNA, 20 bp, Artificial Sequence
  Primer
tgtcatcgagagcagaagca

SEQ ID NO: 943 - DNA, 20 bp, Artificial Sequence
  Primer
cacaacgtactcgaagtacc

SEQ ID NO: 944 - DNA, 20 bp, Artificial Sequence
  Primer
aggtcactcagccttgtacc

SEQ ID NO: 945 - DNA, 20 bp, Artificial Sequence
  Primer
cacaacgtactcgaagtacc

SEQ ID NO: 946 - DNA, 20 bp, Artificial Sequence
  Primer
aggtcactcagccttgtacc

SEQ ID NO: 947 - DNA, 20 bp, Artificial Sequence
  Primer
tcagatggagtcccttgaac

SEQ ID NO: 948 - DNA, 18 bp, Artificial Sequence
  Primer
ctgaatcttgctggtccg

SEQ ID NO: 949 - DNA, 19 bp, Artificial Sequence
  Primer
cagcacattccagattggc

SEQ ID NO: 950 - DNA, 20 bp, Artificial Sequence
  Primer
tgctcaatgtgggagagagc

SEQ ID NO: 951 - DNA, 20 bp, Artificial Sequence
  Primer
gctgttcctacagctctttc

SEQ ID NO: 952 - DNA, 14 bp, Artificial Sequence
  Primer
agccgcacggcagc

SEQ ID NO: 953 - DNA, 20 bp, Artificial Sequence
  Primer
ggttgacttactccagatcg

SEQ ID NO: 954 - DNA, 20 bp, Artificial Sequence
  Primer
ctgaagcaacaggtgccaag

SEQ ID NO: 955 - DNA, 20 bp, Artificial Sequence
  Primer
tggccagtcagctgggagcc

SEQ ID NO: 956 - DNA, 20 bp, Artificial Sequence
  Primer
aagtgtgctgatgtgatgga

SEQ ID NO: 957 - DNA, 20 bp, Artificial Sequence
  Primer
gcatgcgaagtaccttacga

SEQ ID NO: 958 - DNA, 20 bp, Artificial Sequence
  Primer
aacggatccggcaccatgtc

SEQ ID NO: 959 - DNA, 20 bp, Trichoderma reesei
ccccaccgagggtcagaaga

SEQ ID NO: 960 - DNA, 20 bp, Trichoderma reesei
caccgtcctgtctgcctcca

SEQ ID NO: 961 - DNA, 20 bp, Trichoderma reesei
tccaggcccaggcaaagttc

SEQ ID NO: 962 - DNA, 20 bp, Trichoderma reesei
gttcaacgacaagccgccca

SEQ ID NO: 963 - DNA, 20 bp, Trichoderma reesei
gcatgccattgagatcaacc

SEQ ID NO: 964 - DNA, 20 bp, Trichoderma reesei
ccacgcgcggcgccccaagc

SEQ ID NO: 965 - DNA, 20 bp, Trichoderma reesei
attacgttgcagctcgacac

SEQ ID NO: 966 - DNA, 20 bp, Trichoderma reesei
caccacctttgtcgacgcca

SEQ ID NO: 967 - DNA, 20 bp, Trichoderma reesei
gacgccatcaataacctcac

SEQ ID NO: 968 - DNA, 20 bp, Trichoderma reesei
cccgatgcgcccaacaccgc

SEQ ID NO: 969 - DNA, 20 bp, Trichoderma reesei
tcgcagatccgcgtccgcgc

SEQ ID NO: 970 - DNA, 20 bp, Trichoderma reesei
atctatctaagcatttcgca

SEQ ID NO: 971 - DNA, 20 bp, Trichoderma reesei
gctgcccctgatgcgactat

SEQ ID NO: 972 - DNA, 20 bp, Trichoderma reesei
gtcgaccaactccatactca

SEQ ID NO: 973 - DNA, 20 bp, Trichoderma reesei
aacgacaccgacatcttcta

SEQ ID NO: 974 - DNA, 20 bp, Trichoderma reesei
cgcgtacatcttcgaattcg

SEQ ID NO: 975 - DNA, 20 bp, Trichoderma reesei
ctgaagcacactttcaagat

SEQ ID NO: 976 - DNA, 20 bp, Trichoderma reesei
cttgttcccactaccaagca

SEQ ID NO: 977 - DNA, 20 bp, Trichoderma reesei
actccttcagcatgcacacc

SEQ ID NO: 978 - DNA, 20 bp, Trichoderma reesei
agaaaccgttaagcagatca

SEQ ID NO: 979 - DNA, 20 bp, Trichoderma reesei
aacaagaacagcacgttcga

SEQ ID NO: 980 - DNA, 20 bp, Trichoderma reesei
gtgatggcacctacgatgcc

SEQ ID NO: 981 - DNA, 20 bp, Trichoderma reesei
gtgctgcccgccgctccaac

SEQ ID NO: 982 - DNA, 20 bp, Trichoderma reesei
gtcattgattcgcccccaga

SEQ ID NO: 983 - DNA, 20 bp, Trichoderma reesei
cgcgaattcccctcagactc

SEQ ID NO: 984 - DNA, 20 bp, Trichoderma reesei
gagcttctacaagttcgcaa

SEQ ID NO: 985 - DNA, 20 bp, Trichoderma reesei
cctcgactcgcgcttcgtca

SEQ ID NO: 986 - DNA, 20 bp, Trichoderma reesei
gcagccagcactcccaccta

SEQ ID NO: 987 - DNA, 20 bp, Trichoderma reesei
tctccgacccctcaagccca

SEQ ID NO: 988 - DNA, 20 bp, Trichoderma reesei
gcagttctgccgtcgagtct

SEQ ID NO: 989 - DNA, 20 bp, Trichoderma reesei
gagataccagcaacgcgcga

SEQ ID NO: 990 - DNA, 20 bp, Trichoderma reesei
gatccttcatcagaaacatt

SEQ ID NO: 991 - DNA, 20 bp, Trichoderma reesei
gcagccatatatcgacagcc

SEQ ID NO: 992 - DNA, 20 bp, Trichoderma reesei
cagacgacgacgctcaagaa

SEQ ID NO: 993 - DNA, 20 bp, Trichoderma reesei
gacgctgcctcatctagtcg

SEQ ID NO: 994 - DNA, 20 bp, Trichoderma reesei
gctgcgcgatctcgacttca

SEQ ID NO: 995 - DNA, 20 bp, Trichoderma reesei
ctcacattctctattcacga

SEQ ID NO: 996 - DNA, 20 bp, Trichoderma reesei
tgtgctcctgaccgacaagc

SEQ ID NO: 997 - DNA, 20 bp, Trichoderma reesei
actgccgtggacattgccaa

SEQ ID NO: 998 - DNA, 20 bp, Trichoderma reesei
cagtcaccagcaagacaaag

SEQ ID NO: 999 - DNA, 20 bp, Trichoderma reesei
cgacctccacgatgtcatca

SEQ ID NO: 1000 - DNA, 20 bp, Trichoderma reesei
aagacgaagctccgccaatc

SEQ ID NO: 1001 - DNA, 20 bp, Trichoderma reesei
aagagcacgaccgtttcgtc

SEQ ID NO: 1002 - DNA, 20 bp, Trichoderma reesei
tctgacgctgctcctcgcga

SEQ ID NO: 1003 - DNA, 20 bp, Trichoderma reesei
atcaccgacacgcgagacct

SEQ ID NO: 1004 - DNA, 20 bp, Trichoderma reesei
gtcgctggcctcgtccctca

SEQ ID NO: 1005 - DNA, 20 bp, Trichoderma reesei
gagctcgtccgacccccgcc

SEQ ID NO: 1006 - DNA, 20 bp, Trichoderma reesei
ccctgtccctgaccttacaa

SEQ ID NO: 1007 - DNA, 20 bp, Trichoderma reesei
gaaatcacaacactgccaaa

SEQ ID NO: 1008 - DNA, 20 bp, Trichoderma reesei
gaactcaacctccaagacgc

SEQ ID NO: 1009 - DNA, 20 bp, Trichoderma reesei
gagtatgttgccatgttcct

SEQ ID NO: 1010 - DNA, 20 bp, Trichoderma reesei
cacggagactgctgccgctc

SEQ ID NO: 1011 - DNA, 20 bp, Trichoderma reesei
ctacttcacctacgacatcc

SEQ ID NO: 1012 - DNA, 20 bp, Trichoderma reesei
catcctcaccatcctcacca

SEQ ID NO: 1013 - DNA, 20 bp, Trichoderma reesei
gctctcacgaaatcctcgac

SEQ ID NO: 1014 - DNA, 20 bp, Trichoderma reesei
gctctctgagcctgcaagac

SEQ ID NO: 1015 - DNA, 20 bp, Trichoderma reesei
ccgcgtctcctgcacgtagt

SEQ ID NO: 1016 - DNA, 20 bp, Trichoderma reesei
tgcgcgaccccgtcatcgtc

SEQ ID NO: 1017 - DNA, 20 bp, Trichoderma reesei
acctctctggtccacgacct

SEQ ID NO: 1018 - DNA, 20 bp, Trichoderma reesei
gactcctccctccacaccgt

SEQ ID NO: 1019 - DNA, 20 bp, Trichoderma reesei
tctgtcgaggagagcaacat

SEQ ID NO: 1020 - DNA, 20 bp, Trichoderma reesei
acgcgcaacaaccgccgcac

SEQ ID NO: 1021 - DNA, 20 bp, Trichoderma reesei
gcccgaccggttcaacgtcc

SEQ ID NO: 1022 - DNA, 20 bp, Trichoderma reesei
ttcgacaagctcacttacaa

SEQ ID NO: 1023 - DNA, 20 bp, Trichoderma reesei
cttcgactcccactccaaga

SEQ ID NO: 1024 - DNA, 20 bp, Trichoderma reesei
cgccgctgccctcttcgaaa

SEQ ID NO: 1025 - DNA, 20 bp, Trichoderma reesei
cgtcacagagcacttcttcc

SEQ ID NO: 1026 - DNA, 20 bp, Trichoderma reesei
cagcacgactccatctacgc

SEQ ID NO: 1027 - DNA, 20 bp, Trichoderma reesei
aaccacatcgccgagaacaa

SEQ ID NO: 1028 - DNA, 20 bp, Trichoderma reesei
ccttgtctatgcgaatgacc

SEQ ID NO: 1029 - DNA, 20 bp, Trichoderma reesei
agcagcagcagcacgagcag

SEQ ID NO: 1030 - DNA, 20 bp, Trichoderma reesei
tccacgtttgagctgcgtgt

SEQ ID NO: 1031 - DNA, 20 bp, Trichoderma reesei
atccccatccaccagaagcg

SEQ ID NO: 1032 - DNA, 20 bp, Trichoderma reesei
cgtcttcgaccgaatacaag

SEQ ID NO: 1033 - DNA, 68 bp, Artificial Sequence
  Primer
cagcgtcgaaagatttcatcaaaccgctcaattgaccatcgcggccgcgatgcgaagcgaatggagca

SEQ ID NO: 1034 - DNA, 68 bp, Artificial Sequence
  Primer
gcgctggcaacgagagcagagcagcagtagtcgatgctagggcgcgcctatacctcacaatagacgga

SEQ ID NO: 1035 - DNA, 20 bp, Artificial Sequence
  Primer
ctagcatcgactactgctgc

SEQ ID NO: 1036 - DNA, 76 bp, Artificial Sequence
  Primer
ttttcagacaagtccgcccctgctccattcgcttcgcatcgcggccgcggcgcgccatgcaaagatacacatcaat

SEQ ID NO: 1037 - DNA, 20 bp, Artificial Sequence
  Primer
gtcttggccatcaatggagt

SEQ ID NO: 1038 - DNA, 20 bp, Artificial Sequence
  Primer
acggcttacgaacaacgagt

SEQ ID NO: 1039 - DNA, 20 bp, Artificial Sequence
  Primer
acatcctggccgatattctg

SEQ ID NO: 1040 - DNA, 20 bp, Artificial Sequence
  Primer
gctgtagctggtggagaagc

SEQ ID NO: 1041 - DNA, 68 bp, Artificial Sequence
  Primer
ttgcaagtcggactctggacgcttcgtgaaatcccccgcagcggccgcacattagagctctctcctcc

SEQ ID NO: 1042 - DNA, 68 bp, Artificial Sequence
  Primer
gcgctggcaacgagagcagagcagcagtagtcgatgctagggcgcgcctacggctgtcacaatgcaca

SEQ ID NO: 1043 - DNA, 76 bp, Artificial Sequence
  Primer
tacccagacgtagagaaggaggaggagagagctctaatgtgcggccgcggcgcgccatgcaaagatacacatcaat

SEQ ID NO: 1044 - DNA, 20 bp, Artificial Sequence
  Primer
gaaccagcgctccaatacct

SEQ ID NO: 1045 - DNA, 20 bp, Artificial Sequence
  Primer
gggctgtgtgtgtgtgtttg

SEQ ID NO: 1046 - DNA, 20 bp, Artificial Sequence
  Primer
gcctggtcgatactgctctc

SEQ ID NO: 1047 - DNA, 20 bp, Artificial Sequence
  Primer
cctgttgggtatgaaggcgt

SEQ ID NO: 1048 - DNA, 21 bp, Artificial Sequence
  Primer
gcctttgggtgtacatgtttg

We claim:

1. A Trichoderma reesei filamentous fungal cell comprising at least one endogenous protease having reduced or no protease activity, and a recombinant polynucleotide encoding a heterologous polypeptide, wherein the gene encoding endogenous amp2 protease of SEQ ID NO:775 comprises a mutation that reduces or eliminates the activity of the endogenous amp2 protease, and wherein the production level of the heterologous polypeptide is at least two-fold higher than the production level of the same polypeptide as produced in a corresponding parental filamentous fungal cell in which the gene encoding endogenous amp2 protease of SEQ ID NO:775 does not comprise a mutation that reduces or eliminates the activity of the endogenous amp2 protease.

2. The Trichoderma reesei filamentous fungal cell of claim 1, wherein the cell further has reduced or no detectable protease activity in at least three or four proteases selected from the group consisting of pep1 of SEQ ID NO: 1, pep2 of SEQ ID NO: 182, pep3 of SEQ ID NO:17, pep4 of SEQ ID NO: 37, pep5 of SEQ ID NO: 58, pep8 of SEQ ID NO: 507, pep11 of SEQ ID NO: 522, pep12 of SEQ ID NO: 530, tsp1 of SEQ ID NO: 66, slp1 of SEQ ID NO: 82, slp2 of SEQ ID NO: 98, slp3 of SEQ ID NO: 166, slp7 of SEQ ID NO: 231, gap1 of SEQ ID NO: 118, and gap2 of SEQ ID NO: 129.

3. The Trichoderma reesei filamentous fungal cell of claim 2, wherein the total protease activity is reduced to 40% or less, or 6% or less, of the total protease activity of the corresponding parental filamentous fungal cell in which the proteases do not have the reduced activity.

4. The Trichoderma reesei filamentous fungal cell of claim 1, wherein the heterologous polypeptide is a mammalian polypeptide selected from the group consisting of an antibody and its antigen-binding fragments, a growth factor, an interferon, a cytokine, and an interleukin.

5. The Trichoderma reesei filamentous fungal cell of claim 1, wherein the fungal cell further comprises ALG3 having reduced activity.

6. The Trichoderma reesei filamentous fungal cell of claim 5, wherein the gene encoding ALG3 comprises a mutation that reduces or eliminates the corresponding activity.

7. The Trichoderma reesei filamentous fungal cell of claim 1, further comprising
   a) an N-acetylglucosaminyltransferase I catalytic domain, and, optionally,
   b) an N-acetylglucosaminyltransferase II catalytic domain.

8. A method of improving the stability of a heterologous polypeptide, comprising
   a) providing the Trichoderma reesei filamentous fungal cell of claim 1, and
   b) culturing the cell such that the heterologous polypeptide is expressed, wherein the heterologous polypeptide exhibits increased stability compared to the heterologous polypeptide produced in a corresponding parental filamentous fungal cell in which the endogenous amp2 protease does not have reduced activity.

9. A method of making a heterologous polypeptide, comprising
   a) providing the Trichoderma reesei filamentous fungal cell of claim 1;
   b) culturing the cell such that the heterologous polypeptide is expressed; and,
   c) purifying the heterologous polypeptide.

* * * * *